(12) United States Patent
Ma et al.

(10) Patent No.: US 12,275,787 B2
(45) Date of Patent: *Apr. 15, 2025

(54) CHIMERIC ANTIGEN RECEPTORS (CARS), COMPOSITIONS AND METHODS THEREOF

(71) Applicant: iCell Gene Therapeutics LLC, Stony Brook, NY (US)

(72) Inventors: Yupo Ma, Stony Brook, NY (US); Kevin Pinz, Stony Brook, NY (US); Xun Jiang, Stony Brook, NY (US); Masayuki Wada, Stony Brook, NY (US); Kevin Chen, Stony Brook, NY (US)

(73) Assignee: iCell Gene Therapeutics LLC, Stony Brook, NY (US)

( * ) Notice: Subject to any disclaimer, the term of this patent is extended or adjusted under 35 U.S.C. 154(b) by 680 days.

This patent is subject to a terminal disclaimer.

(21) Appl. No.: 16/626,233

(22) PCT Filed: Jun. 20, 2018

(86) PCT No.: PCT/US2018/038529
§ 371 (c)(1),
(2) Date: Dec. 23, 2019

(87) PCT Pub. No.: WO2018/237022
PCT Pub. Date: Dec. 27, 2018

(65) Prior Publication Data
US 2020/0223918 A1      Jul. 16, 2020

Related U.S. Application Data

(63) Continuation of application No. 15/538,620, filed on Jun. 21, 2017, now Pat. No. 11,820,819.
(Continued)

(51) Int. Cl.
| | | |
|---|---|---|
| C07K 16/28 | (2006.01) |
| A61K 39/00 | (2006.01) |
| A61P 35/00 | (2006.01) |
| A61P 35/02 | (2006.01) |
| A61P 37/06 | (2006.01) |
| C07K 14/54 | (2006.01) |
| C07K 14/705 | (2006.01) |
| C07K 14/725 | (2006.01) |

(Continued)

(52) U.S. Cl.
CPC ...... *C07K 16/2803* (2013.01); *A61K 39/4611* (2023.05); *A61K 39/4613* (2023.05); *A61K 39/4631* (2023.05); *A61K 39/464402* (2023.05); *A61K 39/464411* (2023.05); *A61K 39/464412* (2023.05); *A61K 39/464413* (2023.05); *A61K 39/464417* (2023.05); *A61K 39/464424* (2023.05); *A61K 39/46444* (2023.05); *A61K 39/464463* (2023.05); *A61K 39/464471* (2023.05); *A61P 35/00* (2018.01); *A61P 35/02* (2018.01); *A61P 37/06* (2018.01); *C07K 14/5443* (2013.01); *C07K 14/7051* (2013.01); *C07K 14/70517* (2013.01); *C07K 14/70578* (2013.01); *C07K 16/2812* (2013.01); *C07K 16/2866* (2013.01); *C07K 16/3061* (2013.01); *C12N 5/0636* (2013.01); *A61K 38/00* (2013.01); *A61K 2039/505* (2013.01); *A61K 2239/28* (2023.05); *A61K 2239/31* (2023.05); *A61K 2239/38* (2023.05); *A61K 2239/48* (2023.05); *C07K 16/28* (2013.01); *C07K 16/2887* (2013.01); *C07K 16/289* (2013.01); *C07K 16/2896* (2013.01); *C07K 2317/622* (2013.01); *C07K 2317/73* (2013.01); *C07K 2319/02* (2013.01); *C07K 2319/03* (2013.01); *C07K 2319/74* (2013.01)

(58) Field of Classification Search
CPC ............ A61K 35/17; A61K 39/001112; A61K 2039/507; A61K 2039/5156; A61P 35/00; C07K 14/5443; C07K 14/7051; C07K 14/70578; C07K 16/2866; C07K 2317/622; C07K 2317/73; C07K 2319/02; C07K 2319/03; C07K 2319/74; C07K 2317/31; C07K 14/70521; C07K 16/2878; C12N 5/0636

See application file for complete search history.

(56) References Cited

U.S. PATENT DOCUMENTS

| | | |
|---|---|---|
| 8,399,645 B2 | 3/2013 | Campana et al. |
| 9,328,156 B2 | 5/2016 | June et al. |

(Continued)

FOREIGN PATENT DOCUMENTS

| | | | |
|---|---|---|---|
| EP | 3288940 B1 | 3/2018 | |
| WO | WO-2007046006 A2 * | 4/2007 | ............. A61P 31/00 |

(Continued)

OTHER PUBLICATIONS

Osborn et al. A Picornaviral 2A-Like Sequence-Based Tricistronic Vector Allowing for High-Level Therapeutic Gene Expression Coupled to a Dual-Reporter System. Molecular Therapy vol. 12, No. 3, Sep. 2005 (Year: 2005).*

(Continued)

*Primary Examiner* — Amy E Juedes
*Assistant Examiner* — Brian Hartnett
(74) *Attorney, Agent, or Firm* — Hoffmann & Baron, LLP

(57) ABSTRACT

The present disclosure provides chimeric antigen receptors, compostions, and methods thereof. In one embodiment the present disclosure provides a method of treating autoimmune diseases, asthma, and preventing or mediating organ rejection in a subject.

2 Claims, 231 Drawing Sheets
Specification includes a Sequence Listing.

Related U.S. Application Data

(60) Provisional application No. 62/523,147, filed on Jun. 21, 2017.

(51) Int. Cl.
*C07K 16/30* (2006.01)
*C12N 5/0783* (2010.01)
*A61K 38/00* (2006.01)

(56) References Cited

U.S. PATENT DOCUMENTS

| | | |
|---|---|---|
| 10,117,896 B2 | 11/2018 | Powell, Jr. et al. |
| 10,196,444 B2 | 2/2019 | Jarjour et al. |
| 10,253,086 B2 | 4/2019 | Bitter et al. |
| 10,273,280 B2 | 4/2019 | Yupo et al. |
| 10,287,354 B2 | 5/2019 | Brogdon et al. |
| 10,457,731 B2 | 10/2019 | Jarjour et al. |
| 10,472,613 B2 | 11/2019 | Duchateau et al. |
| 11,173,179 B2 | 11/2021 | Ma et al. |
| 2002/0009449 A1 | 1/2002 | Wallner et al. |
| 2003/0105000 A1 | 6/2003 | Pero et al. |
| 2003/0147865 A1 | 8/2003 | Salomon et al. |
| 2004/0265315 A1 | 12/2004 | Dingivan et al. |
| 2005/0277587 A1 | 12/2005 | Chen et al. |
| 2008/0254027 A1 | 10/2008 | Bernett et al. |
| 2008/0254512 A1 | 10/2008 | Capon |
| 2008/0299042 A1 | 12/2008 | Bechtel et al. |
| 2009/0081157 A1 | 3/2009 | Kornbluth et al. |
| 2009/0238791 A1 | 9/2009 | Jacques et al. |
| 2009/0325188 A1 | 12/2009 | Glass |
| 2010/0331527 A1 | 12/2010 | Davis et al. |
| 2012/0058082 A1 | 3/2012 | Kaplan et al. |
| 2012/0070408 A1 | 3/2012 | Kaplan |
| 2012/0134970 A1 | 5/2012 | Yang et al. |
| 2012/0258494 A1 | 10/2012 | Stitz |
| 2013/0058936 A1 | 3/2013 | Bruenker et al. |
| 2013/0259876 A1 | 10/2013 | Murphy et al. |
| 2013/0287748 A1 | 10/2013 | June et al. |
| 2013/0287752 A1 | 10/2013 | Davila et al. |
| 2014/0044641 A1 | 2/2014 | Toporik et al. |
| 2014/0099309 A1 | 4/2014 | Powell, Jr. et al. |
| 2014/0106449 A1 | 4/2014 | June et al. |
| 2014/0286918 A1 | 9/2014 | Dao |
| 2014/0322183 A1 | 10/2014 | Milone et al. |
| 2015/0038684 A1 | 2/2015 | Jensen |
| 2015/0133640 A1 | 5/2015 | Blein et al. |
| 2015/0140019 A1 | 5/2015 | June et al. |
| 2015/0307623 A1 | 10/2015 | Abbot et al. |
| 2015/0342993 A1 | 12/2015 | Kloss et al. |
| 2016/0068601 A1 | 3/2016 | Brogdon et al. |
| 2016/0207989 A1 | 7/2016 | Short |
| 2016/0250258 A1 | 9/2016 | Delaney et al. |
| 2016/0297989 A1 | 10/2016 | Nimura et al. |
| 2016/0340406 A1 | 11/2016 | Zhao et al. |
| 2017/0145108 A1 | 5/2017 | Schreiber et al. |
| 2017/0267742 A1 | 9/2017 | Jensen et al. |
| 2018/0066034 A1 | 3/2018 | Yupo et al. |
| 2018/0162939 A1 | 6/2018 | Yupo et al. |
| 2018/0179280 A1 | 6/2018 | Png et al. |
| 2018/0187149 A1 | 7/2018 | Ma et al. |
| 2018/0371052 A1 | 12/2018 | Yupo et al. |
| 2019/0038733 A1 | 2/2019 | Campana et al. |
| 2019/0046571 A1 | 2/2019 | Campana et al. |
| 2019/0135894 A1 | 5/2019 | Yupo et al. |
| 2019/0255108 A1 | 8/2019 | Yupo et al. |
| 2019/0345217 A1 | 11/2019 | Ma et al. |
| 2020/0024342 A9 | 1/2020 | Ma et al. |
| 2020/0071397 A1 | 3/2020 | Dipersio et al. |
| 2020/0071399 A1 | 3/2020 | Jarjour et al. |
| 2020/0078399 A1 | 3/2020 | Fan et al. |
| 2020/0109364 A1 | 4/2020 | Dipersio et al. |
| 2020/0283534 A1 | 9/2020 | Ma et al. |
| 2020/0308541 A1 | 10/2020 | Ma et al. |
| 2020/0371091 A1 | 11/2020 | Pruteanu-Malinici et al. |
| 2022/0241327 A1 | 8/2022 | Ma et al. |
| 2022/0348633 A1 | 11/2022 | Ma et al. |
| 2023/0277622 A1 | 9/2023 | Ma et al. |
| 2023/0340113 A1 | 10/2023 | Ma et al. |
| 2024/0141041 A1 | 5/2024 | Ma et al. |

FOREIGN PATENT DOCUMENTS

| | | | |
|---|---|---|---|
| WO | 2009091826 A2 | 7/2009 | |
| WO | 2012079000 A1 | 6/2012 | |
| WO | 2013123061 A1 | 8/2013 | |
| WO | 2013126712 A1 | 8/2013 | |
| WO | 2014055668 A1 | 4/2014 | |
| WO | 2014100385 A1 | 6/2014 | |
| WO | 2014124143 A1 | 8/2014 | |
| WO | 2014127261 A1 | 8/2014 | |
| WO | 2014145252 A2 | 9/2014 | |
| WO | 2014184143 A1 | 11/2014 | |
| WO | 2014186469 A2 | 11/2014 | |
| WO | 2015018529 A1 | 2/2015 | |
| WO | 2015075468 A1 | 5/2015 | |
| WO | 2015075469 A1 | 5/2015 | |
| WO | 2015075470 A1 | 5/2015 | |
| WO | WO-2015120180 A1 * | 8/2015 | ........... A61K 39/395 |
| WO | WO-2015121454 A1 * | 8/2015 | ............ A61K 35/17 |
| WO | 2015157399 A1 | 10/2015 | |
| WO | 2015168613 A2 | 11/2015 | |
| WO | 2015172339 A1 | 11/2015 | |
| WO | 2016011210 A2 | 1/2016 | |
| WO | 2016014553 A1 | 1/2016 | |
| WO | WO-2016014565 A2 * | 1/2016 | ............ A61K 35/12 |
| WO | 2016102965 A1 | 6/2016 | |
| WO | 2016210293 A1 | 12/2016 | |
| WO | 2017068361 A1 | 4/2017 | |

OTHER PUBLICATIONS

Szymczak et al.Correction of multi-gene deficiency in vivo using a single 'self-cleaving' 2A peptide-based retroviral vector. Nature Biotechnology vol. 22 No. 5 May 2004 (Year: 2004).*

Hoyos et al. Engineering CD19 specific T lymphocytes with interleukin-15 and a suicide gene to enhance their anti-lymphoma/leukemia effects and safety. Leukemia (2010) 24, 1160-1170 (Year: 2010).*

Lanitis et al .Optimized gene engineering of murine CAR-T cells reveals the beneficial effects of IL-15 co-expression. J. Exp. Med. 2020 vol. 218 No. 2 e20192203 (Year: 2019).*

Qi et al_Interleukin-12 exacerbates Sjogren's syndrome through induction of myeloid-derived suppressor cells. Molecular Medicine RE POR TS 20: 1131-1138, 2019. (Year: 2019).*

Liu, Fang, et al., "First-in-Human CLL1-CD33 Compound Car T Cell Therapy Induces Complete Remission in Patients with Refractory Acute Myeloid Leukemia: Update on Phase 1 Clinical Trial," http://www.bloodjournal.org/content/132/Suppl_1/901?sso-checked=true.

John, Liza B., et al., "Anti-PD-1 Antibody Therapy Potently Enhances the Eradication of Established Tumors by Gene-Modified T Cells," Clinical Cancer Research; 19, No. 20, pp. 5636-5646, Oct. 15, 2013.

Rowley, Jesse, et al., "Expression of IL-15RA or an IL-15/IL-15RA fusion on CD8+ T cells modifies adoptively transferred T-cell function in cis," European Journal of Immunology, 39, No. 2: 491-506, 2009.

Gill, Saar, MD, Phd, "Chimeric Antigen Receptor T-Cell Therapy in AML: How Close are We?", Best Practice & Research Clinical Haematology, Dec. 2016; 29(4): 329-333. doi:10.1016/j.beha.2016.10.004.

Chen, KH, et al., "A Compound Chimeric Antigen Receptor Strategy for Targeting Multiple Myelomac" Leukemia (2018) 32, 402-412.

Petrov, Jessica C., et al., "Compound CAR T-Cells as a Double-Pronged Approach for Treating Acute Myeloid Leukemia," Leukemia (2018) 32: 1317-1326.

Hamieh, Mohamad, et al., "CAR T Cell Trogocytosis and Cooperative Killing Regulate Tumour Antigen Escape," Nature 568, 112-116 (2019).

(56) References Cited

OTHER PUBLICATIONS

Qin, Haiying, et al., "Novel CD19/CD22 Bicistronic Chimeric Antigen Receptors Outperform Single or Bivalent Cars In Eradicating CD19+CD22+, CD19- and CD22-Pre-B Leukemia," Blood 2017, 130:810.
Brown, et al., "Novel Treatments for Chronic Lymphocytic Leukemia and Moving Forward," American Society of Clinical Oncology Educational Book, vol. 34, 2014, pp. e317-e325, XP055201368.
Leavitt, et al., "Concordant Modulation of Neutralization Resistance and High Infectivity of the Primary Human Immunodeficiency Virus Type 1 MN Strain and Definition of a Potential gp41 Binding Site," gp120 Journal of Virology, pp. 560-570, Jan. 2003.
Schreiber, et al., "Cancer Immunoediting: Integrating Immunity's Roles in Cancer Suppression and Promotion," pp. 1565-1570, Mar. 2011.
Marzo, et al., "Fully Functional Memory CDS T Cells in the Absence of CD4 T Cells," Journal of Immunology, 173:969-975, 2004.
Moeller, et al., "Sustained Antigen-Specific Antitumor Recall Response Mediated by Gene-Modified CD4+ T Helper-1 and CDS+ T Cells," Cancer Research 67, No. 23 :11428-11437, 2007.
Moeller,et al., "Adoptive Transfer of Gene-Engineered CD4 Helper T Cells Induces Potent Primary and Secondary Tumor Rejection," Blood, vol. 106, No. 9, pp. 2995-3003, Nov. 2005.
Gibson, et al., "Risk of Non-Hodgkin Lymphoma Subtypes in HIV-Infected People During the HAART Era: A Population-Based Study," AIDS, Sep. 24, 2014; 28(15): 2313-2318, London, England.
Beard, et al., "Multiple Chimeric Antigen Receptors Successfully Target Chondroitin Sulfate Proteoglycan 4 in Several Different Cancer Histologies and Cancer Stem Cells," Journal for Immunotherapy of Cancer 2014; 2(25), pp. 1-11.
Imboden, et al., "Stimulation of CDS Enhances Signal Transduction by the T Cell Antigen Receptor," J. Clinical Investigation, 1990; 85:130-134.
Rabinowich, et al., "Signaling Via CD7 Molecules on Human NK Cells. Induction of Tyrosine Phosphorylation and Beta 1 Integrin-Mediated Adhesion to Fibronectin," The Journal of Immunology, 1994; 153:3504-3513.
Inoue, et al., "Mechanisms of NK Cell Activation Stimulated by CD2; Granzyme B is Released by CD2 Crosslinking-Stimulation on NK92 Cells," Journal of Osaka Dental University, Oct. 2012; 46(2): 229-235.
McNerney, et al., "The CD2 Family of Natural Killer Cell Receptors," Immunobiology of Natural Killer Cell Receptors, Sprinter, Berlin, Heidelberg, 2006; 298:91-120.
Rabinowich, et al., "Expression and Function of CD7 Molecule on Human Natural Killer Cells," Journal of Immunology, 1994; 152: 517-526.
Liu, et al., "Critical Role of CD2 Co-stimulation in Adaptive Natural Killer Cell Responses Revealed in NKG2CDeficient Humans," Cell Reports 2016; 15, 1088-1099.
Muyldermans, et al., "Single Domain Camel Antibodies: Current Status," Reviews in Molecular Biotechnology 74, No. 4, , (2001): pp. 277-301, 22001. 277302.
Muyldermans, et al., "Recognition of Antigens by Singledomain Antibody Fragments: The Superfluous Luxury of Paired Domains," Trends in Biochemical Sciences, vol. 26, No. 4, pp. 230-235, Apr. 2001.
Grupp, et al., "Chimeric Antigen Receptor-Modified T Cells for Acute Lymphoid Leukemia," New England Journal of Medicine, Apr. 18, 2013, vol. 368, No. 16, pp. 1509-1518.
Rowley, et al., "Expression of IL-15RA or an IL-15/1L-15RA Fusion on CD8+ T Cells Modifies Adoptively Transferred T-Cellfunction in cis," European Journal of Immunology, 2009, vol. 39, No. 2, pp. 491-506.
John et al., "Anti-PD-1 Antibody Therapy Potently Enhances the Eradication of Established Tumors By Gene-Modified T Cells," Clinical Cancer Research, Oct. 15, 2013, vol. 19, No. 20, pp. 5636-5646.

Penney, et al., "Greater Frequency of CD5-Negative CD8(+) T Vells Against Human Immunodeficiency Virus Type 1 than Other Viruses is Consistent with Adaptation to Antigenic Variation," AIDS Research and Therapy, Sep. 15, 2014, vol. 11, No. 30, pp. 1-10.
Maus, et al., "Antibody-Modified T Cells: CARs Take the Front Seat for Hematologic Malignancies," Blood, Apr. 24, 2014, vol. 123, No. 17, pp. 2625-2635.
D'Amore, et al., "Phase II Trial of Zanolimumab (HuMax-CD4) in Relapsed or Refractory Non-Cutaneous Peripheral T Cell Lymphoma," British Journal of Haematology, 150, No. 5, pp. 565-573, 2010.
Shenghui, et al., "Elevated Frequencies of CD4+CD25+CD127lo regulatory T Cells is Associated to Poor Prognosis in Patients with Acute Myeloid Leukemia," International Journal of Cancer, 129 No. 6, pp. 1373-1381, 2011.
Ehninger et al., "Distribution and Levels of Cell Surface Expression of CD33 and CD123 in Acute Myeloid Leukemia," Blood Cancer Journal 2014, vol. 4, pp. 1-10.
Liu, et al., "512. Tumor-Associated Macrophages Via Up-Regulation of PD1 Ligands Protect Neuroblastoma from Immunotherapy With NKT Cells Expressing GD2-Specific Chimeric Antigen Receptor," Molecular Therapy 23 (2015): S205, Abstract 512.
Rouce, et al., "Equal Opportunity Car T cells," Blood 2017, 129:3275-3277.
Lai, et al., "The Roles of CD4+ T Cells in Tumor Immunity," ISRN Immunology, vol. 2011, Article ID 497397, 6 pages, DOI:10.5402/2011/497397.
Kebriaei, et al., "Phase I Trials Using Sleeping Beauty to Generate CD19-Specific Car T Cells," The Journal of Clinical Investigation, vol. 126, No. 9, pp. 3363-3376 and Supplemental Tables, Sep. 2016.
Wilkie, et al., Dual Targeting of ErbB2 and MUC1 in Breast Cancer Using Chimeric Antigen Receptors Engineered to Provide Complementary Signaling, Journal of Clinical Immunology, (2012) 32:1059-1070.
Dotti, et al., "Design and Development of Therapies using Chimeric Antigen Receptor-Expressing T Cells," Immunological Reviews, Jan. 2014; 257(1): pp. 1-35.
Curran, Kevin, et al., "Chimeric Antigen Receptors for T Cell Immunotherapy: Current Understanding and Future Directions." The Journal of Gene Medicine, 14.(6), pp. 405-415, Jun. 2012.
Shirasu, N., et al., "Functional Design of Chimeric T-Cell Antigen Receptors for Adoptive Immunotherapy of Cancer: Architecture and Outcomes," Anticancer Research, 32(6), pp. 2377-2384, 2012.
Bridgeman, J.S., et al., "CD 3ζ-Based Chimeric Antigen Receptors Mediate T Cell Activation Via Cis-and Trans-Signalling Mechanisms: Implications for Optimization of Receptor Structure for Adoptive Cell Therapy," Clinical & Experimental Immunology, 175(2), pp. 258-267, 2013.
Kaiser, A.D., et al., "Towards a Commercial Process for the Manufacture of Genetically Modified T Cells for Therapy," Cancer Gene Therapy, 22(2), pp. 72-78, Jan. 2015.
Sentman, C.L., "Challenges of Creating Effective CARs for Cancer Therapy," Immunotherapy, 5(8), pp. 783-785, 2013.
Chen, C., et al., "Development of T Cells Carrying Two Complementary Chimeric Antigen Receptors Against Glypican-3 and Asialoglycoprotein Receptor 1 for the Treatment of Hepatocellular Carcinoma," Cancer Immunology, Immunotherapy 66, No. 4: 475-489, 2017.
Mihara, K., et al., "T Cells Bearing Anti-CD19 and/or Anti-CD38 Chimeric Antigen Receptors Effectively Abrogate Primary Double-Hit Lymphoma Cells," Journal of Hematology & Oncology 10, No. 1: 116-119, 2017.
Zhang, et al., Journal of Hematology & Oncology, 11:102-116, 2018.
Zhu, F., et al., "Closed-System Manufacturing of CD19 and Dual-Targeted CD20/19 Chimeric Antigen Receptor T Cells Using the CliniMACS Prodigy Device at an Academic Medical Center," Cytotherapy 20, No. 3: 394-406, 2018.
Sommermeyer, D., et al., "Chimeric Antigen Receptor-Modified T Cells Derived from Defined CD8+ and CD4+ Subsets Confer Superior Antitumor Reactivity in Vivo," Leukemia, 30(2): 492-500, Feb. 2016.

(56) References Cited

OTHER PUBLICATIONS

Aandahl, E. et al., "Expansion of CD7low and CD7negative CD8 T-Cell Effector Subsets in HIV-1 Infection: Correlation with Antigenic Load and Reversion by Antiretroviral Treatment," Blood, vol. 104, No. 12, pp. 3672-3678 (Dec. 1, 2004).
Abate-Daga, et al., "CAR Models: Next-Generation CAR Modifications for Enhanced T-Cell Function," Molecular Therapy-Oncolytics 3, Article 16014 (2016).
Amlot, P. et al., "Chapter 18 CD7 Monoclonal Antibodies—Therapeutic Monoclonal Antibodies," pp. 287-288 (1990).
Arafat, Waleed, et al. "Antineoplastic Effect of Anti-ErbB-2 Intrabody is not Correlated with scFv Affinity for its Target," Cancer Gene Therapy, vol. 7, No. 9, pp. 1250-1256 (2000).
Brentjens, Renier J., et al. "Eradication of Systemic B-Cell Tumors by Genetically Targeted Human T Lymphocytes Co-Stimulated by CD80 and Interleukin-15," Nature Medicine. vol. 9, No. 3, pp. 279-286 (2003).
Burgess, Wilson H. et al., "Possible Dissociation of the Heparin-Binding and Mitogenic Activities of Heparin-Binding (Acidic Fibroblast) Growth Factor-1 from its Resceptor-Binding Activities by Site-Directed Mutagenesis of a Single Lysine Residue," The Journal of Cell Biology pp. 2129-2138 (1990).
Casset, Florence, et al., "A Peptide Mimetic of an Anti-CD4 Monoclonal Antibody by Rational Design," BBRC, vol. 307, pp. 198-205 (2003).
Chen Yvonne, et al., "Selection and Analysis of an Optimized Anti-VDGG Antibody: Crystal Structure of an Affinity-Matured Fab in Complex with Antigen," J. Mol. Bio., vol. 293, pp. 865-881 (1999).
Colman, P. M. et al., "Effects of Amino Acid Sequence Changes on Antibody-Antigen Interactions," Research in Immunology, vol. 145, No. 1, pp. 33-36 (1994).
De Pascalis, Roberto, et al., "Grafting of 'Abbreviated' Complementarity-Determining Regions Containing Specificity-Determining Residues Essential for Legand Contact to Engineer a Less Immunogenic Humanized Monoclonal Antibody," The Journal of Immunology, vol. 169, pp. 3076-3084 (2002).
Esmaeilzadeh, Abdolreza et al: "Chimeric Antigen Receptor-T Cell Therapy: Applications and Challenges in Treatment of Allergy and Asthma," Biomedicine and Pharmacotherapy, vol. 123, (2019).
Maus, Marcela V., et al. "Antibody-Modified T Cells: CARs Take the Front Seat for Hematologic Malignancies," Blood, The Journal of the American Society of Hematology, vol. 123, No. 17, pp. 2625-2635 (2014).
Fehniger, Todd A., et al., "Fatal Leukemia In Interleukin 15 Trangenic Mice Follows EarlyExpansion in Natural Killer and Memory Phenotype CD8+ T Cells," Journal of Exp. Med. Rockefeller Univ. Press, vol. 193, No. 2, pp. 219-231 (2001).
Almagro & Frans Son, "Humanization of Antibodies," Frontiers in Bioscience vol. 13, pp. 1619-1633 (Jan. 1, 2008).
Glienke, Wolfgang, et al., "Advantages and Applications of CAR-Expressing Natural Killer Cells," Frontiers in Pharmacology, vol. 6, Article 21 (Feb. 2015).
Guo, Yelei et al., "Efficiency and Side Effects of Anti-CD38 Car T Cells in an Adult Patient With Relapsed B-ALL After Failure of Bi-Specific CD19/CD22 Car T Cell Treatment," Cellular & Molecular Immunology, vol. 17, pp. 430-432 (2020).
Hegde, M et al. "Combinational Targeting Offsets Antigen Escape and Enhances Effector Functions of Adoptively Transferred T cells in Glioblastoma," Molecular Therapy, vol. 21, No. 11, pp. 2087-2101 (2013).
Holm, Patrick, et al., "Functional Mapping and Single Chain Constructionof the Anti-Cytokeratin 8 Monoclonal Antibody TS1," Molecular Immunology, vol. 44, pp. 1075-1084 (2002).
Hu, Qiyue, et al. "Discovery of a Novel IL-15 Based Protein with Improved Developability and Efficacy for Cancer Immunotherapy," Scientific Reports, vol. 8, No. 1, p. 7675 (2018).

Hurton, Lenka V., et al., "Tethered IL-15 on CD19-Specific T Cells Sustains Long-Term Persistence and Promotes a Stem Cell Memory-Like Phenotype," Molecular Therapy, Abstract 626, pages S242 (2014).
Jena, Bipulendu, et al., "Redirecting T-Cell Specificity by Introducing a Tumor-Specific Chimeric Antigen Receptor," Blood, vol. 116, No. 7, pp. 1035-1044 (Aug. 2010).
Kang, Liqing, et al., "Characterization of Novel Dual Tandem CD19/BCMA Chimeric Antigen Receptor T Cells to Potentially Treat Muliple Myeloma," Biomarker Research, vol. 8, No. 14 (2020).
Kershaw, Michael H. et al., "Redirected Cytotoxic Effector Function", Journal of Biological Chemistry, vol. 271, No. 35, pp. 21214-21220 (Aug. 1996).
Lang, Peter, et al. "Chimeric CD19 Antibody Mediates Cytotoxic Activity Against Leukemic Blasts with Effector Cells from Pediatric Patients Who Received T-Cell-Depleted Allografts," Blood, vol. 103, No. 10, pp. 3982-3985 (2004).
Lemaistre, C.F., "Phase I Trial of H65-RTA Immunoconjugate in Patients With Cutaneous T-cell Lymphoma", Blood, vol. 78, No. 5, pp. 1173-1182 (Sep. 1, 1991).
Leong, Steven R., et al., "An Anti-CD3/anti-CLL-1 Bispecific Antibody for the Treatment of Acute Myeloid Leukemia," Blood, vol. 129, No. 5, pp. 609-618 (2017).
Ma, Jennifer S. Y., et al., "Versatile Strategy for Controlling the Specificity and Activity of Engineered T cells," PNAS, pp. E450-#458 (2016).
MacCallum, Robert M., et al., "Antibody-Antigen Interactions: Contact Analysis and Binding Site Topography," J. Mol. Biol., vol. 262, pp. 732-745 (1996).
Maude, S. L., et al., "Tisagenlecleucel in Children and Young Adults with B-Cell Lymphoblastic Leukemia," N. England Journal of Medicine, vol. 378, No. 5, pp. 439-446 (Feb. 1, 2018).
Milone, Michael C., et al., "Chimeric Receptors Containing CD137 Signal Transduction Domains Mediate Enhanced Survival of T. Cells and Increased Antileukemic Efficacy in Vivo," Molecular Therapy vol. 17, No. 8, pp. 1453-1464 (Aug. 2009).
Moreaux, Jerome, et al., "BAFF and APRIL Protect Myeloma Cells from Apoptosis Induced by Interleukin 6 Deprivation and Dexamethasone", Blood, vol. 103, No. 8, pp. 3148-4157 (Apr. 2004).
Phares, Timothy W., et al. "CD4 T Cells Promote CD8 T Cell Immunity at the Priming and Effector Site During Viral Encephalitis," Journal of Virology, vol. 86, No. 5. pp, 2416-2427 (2012).
Png, Yi Tian, et al. "Blockade of CD7 Expression in T Cells for Effective Chimeric Antigen Receptor Targeting of T-Cell Malignancies," Blood Advances, vol. 1, No. 25, pp. 2348-2360 (2017).
Ramos Carlos A., et al., "CD19-CAR Trials," Cancer Journal, vol. 20, No. 2, pp. 112-118 (2014).
Rudikoff, Stuart et al., "Single amino acid substitution altering antigen-binding specificity" Proc Natl Acad Sci USA, vol. 79 pp. 1979-1983 (1982).
Ruella, Marco et al., "Dual CD19 and CD123 Targeting Prevents Antigen-Loss Relapses After CD19-Directed Immunotherapies," Journal of Clinical Investigation, vol. 126, Nol 10, pp. 3814-3826 (2016).
Sahm, Christiane et al., "Expression of IL-15 in NK Ccells Results in Rapid Enrichment and Selective Cytotoxicity of Gene-Modified Effectors that Carry a Tumor-Specific Antigen Receptor," Cancer Immunology, Immunotherapy, vol. 61, No. 9, pp. 1451-1461 (Feb. 2012).
Sato, Noriko, et al., "Development of an IL-15-Autocrine CD8 T-cell Leukemia in IL-15-Transgenic Mice Requires the CIS Expression of IL-15R," Blood, vol. 117, No. 15 pp. 4032-4040 (2018).
Skuljec, Jelena, et al., "Chimeric Antigen Receptor-Redirected Regulatory T Cells Suppress Experimental Allergic Airway Inflammation, a Model of Asthma," Frontiers in Immunology, vol. 8, Article 1125 (Sep. 2017).
Vajdos, Felix F., et al."Comprehensive Functional Maps of the Antigen-binding Site of an Anti-ErbB2 Antibody Obtained with Shotgun Scanning Mutagenesis," J. Mol. Biol. Vol. 320, pp. 415-428 (2002).

(56) References Cited

OTHER PUBLICATIONS

Wang, Weijia, et al. "BCMA-CD19 Compound CAR T Cells for Systemic Lupus Erythematosus: A Phase 1 Open-Label Clinical Trial," Annals of the Rheumatic Diseases, vol. 83, No. 10 (Abstract) (2024).
Ward, Dana E., et al. "Chimeric Antigen Receptors Based on Low Affinity Mutants of FcεRI Re-Direct T Cell Specificity to Cells Expressing Membrane IgE," Frontiers in Immunology, vol. 9, Article 2231 (2018).
Wilkie et al., "Selective Expansion of Chimeric Antigen Receptor-Targeted T-Cells with Potent Effector Function Using Interleukin-4," Journal of Biological Chemistry, vol. 285, No. 33, pp. 25538-25544 (2010).
Chen, et al., "CD7 Nanobody-Derived Anti-CD7 Chimeric Antigen Receptor T-Cells Exhibited Potent Antitumor Activities to CD7 Positive Malignancies," (HemaSphere, vol. 4, Supp 1, pp. 100-101, Abstract No. S277, (English Abstract from EMBASE) (Jun. 2020).
Fan et al., "The Killing Activity of a CD7 Nanobody Derived CAR-T Cells on CD7 Positive Acute Myeloid Leukemia Cells," Chinese Journal of Cancer Biotherapy, vol. 27, No. 8, pp. 852-859, English Abstract from EMBASE (Aug. 2020).
Mortier, Erwan, et al., "Soluble Interleukin-15 Receptor Alpha (IL-15Ralpha)-Sushi as a Selective and Potent Agonist of IL-15 Action through IL-15Rb/y;" Journal of Biological Chemistry, vol. 281, No. 3, pp. 1612-1619 (2006).

\* cited by examiner

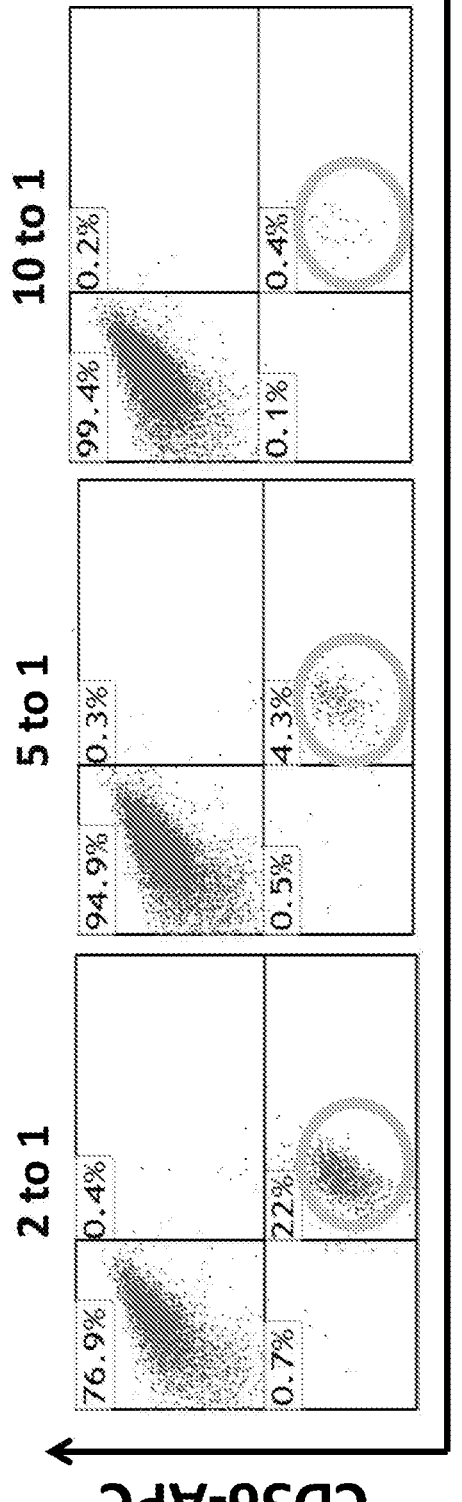
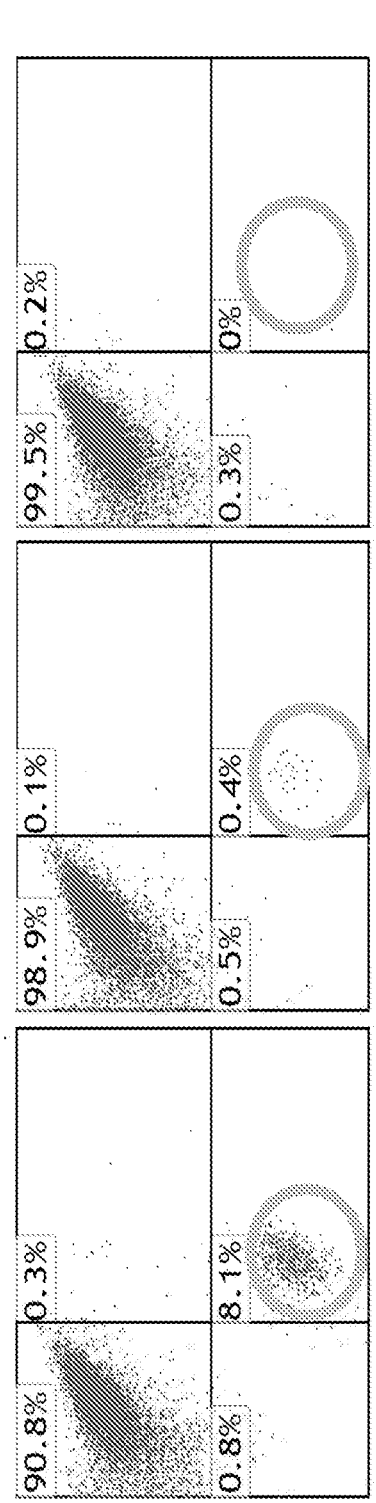
FIGURE 9

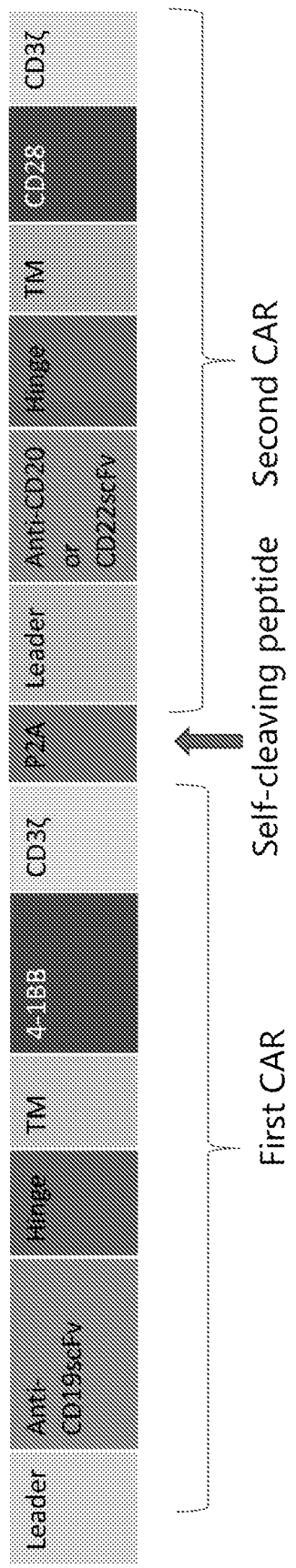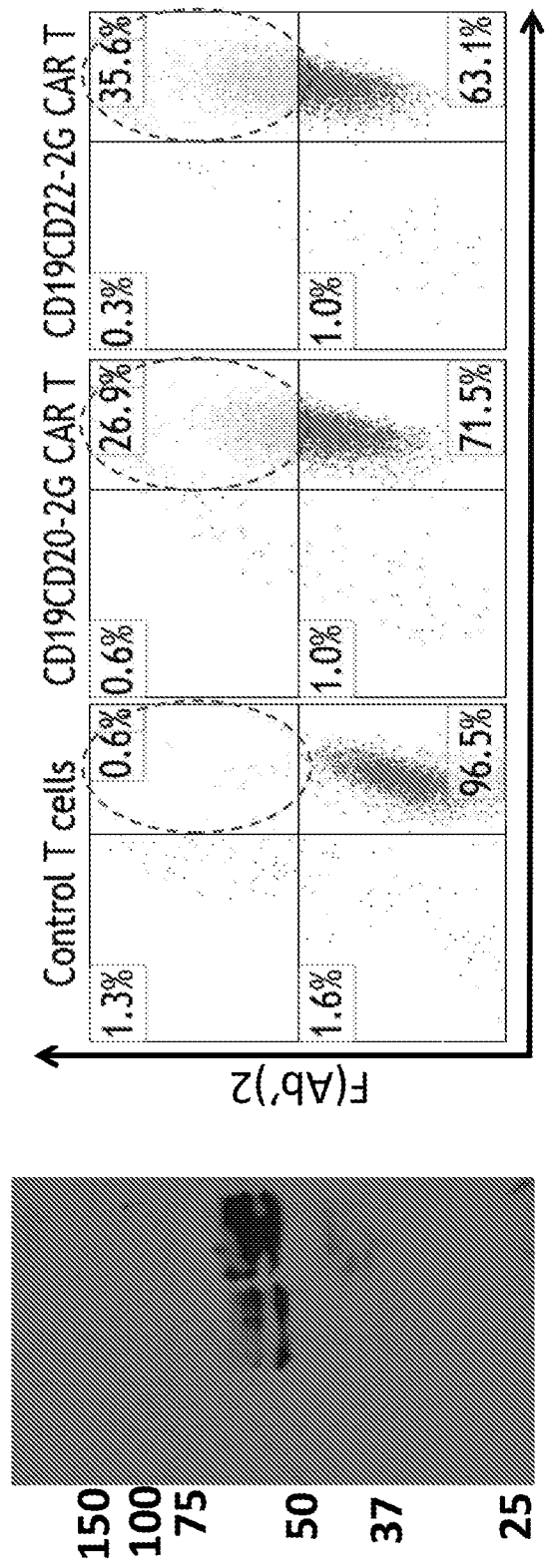
FIGURE 16A
FIGURE 16B

269-CS1 (BC1cCAR) construct schematic

BC1cCAR surface expression as a measure of the transduction methodology

FIGURE 27B
Short-term BCMA depletion by BC1cCAR T-cells
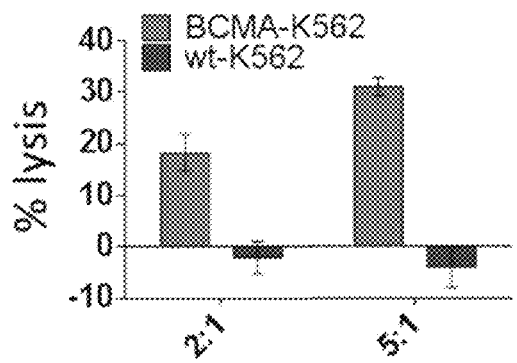
Short-term CS1 depletion by BC1cCAR T vs. CS1 CAR T
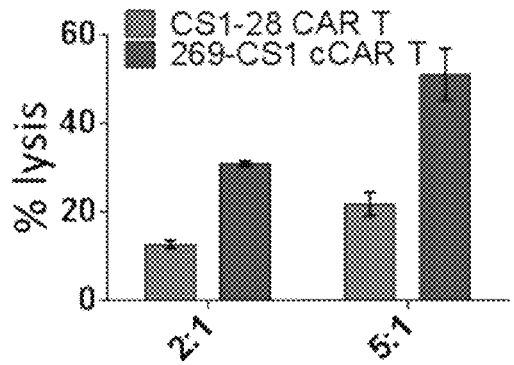
Anti-CS1 activity of BC1cCAR T against CS1$^{dim}$ NK-92 cells
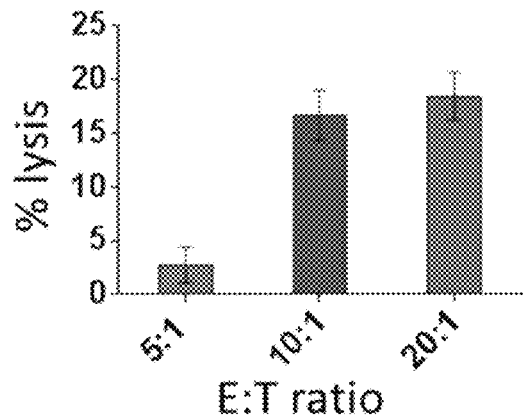

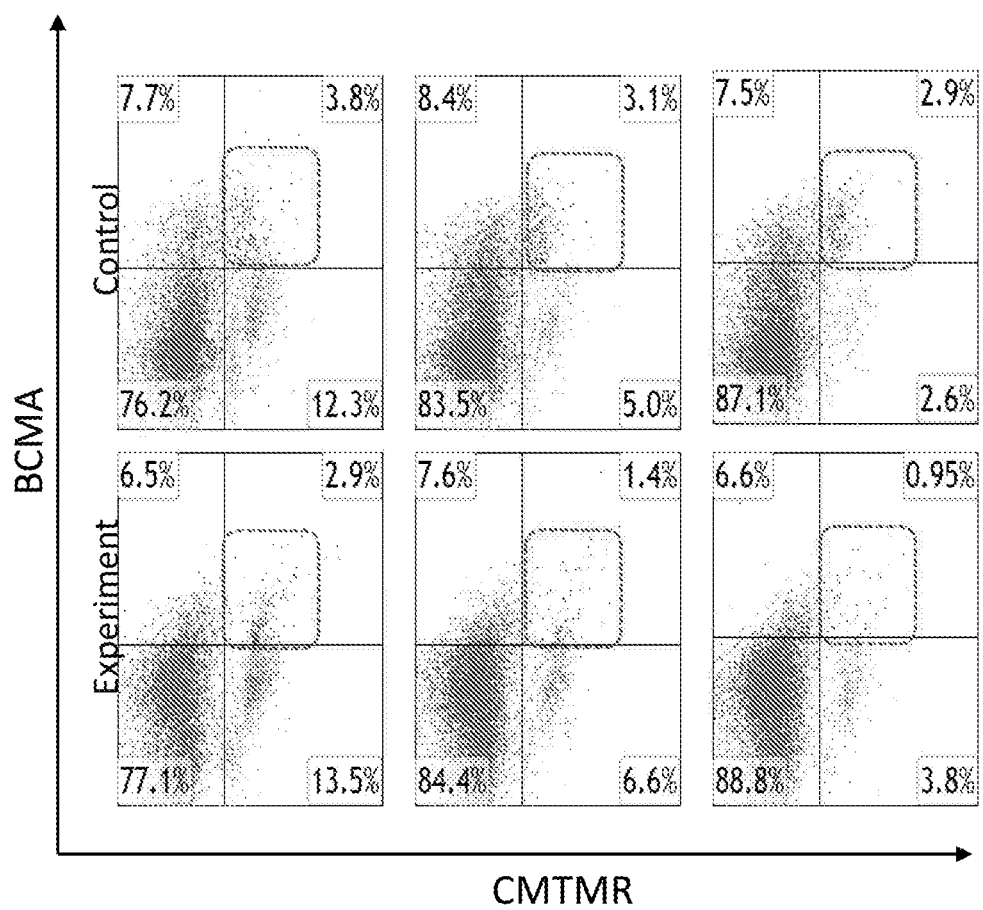
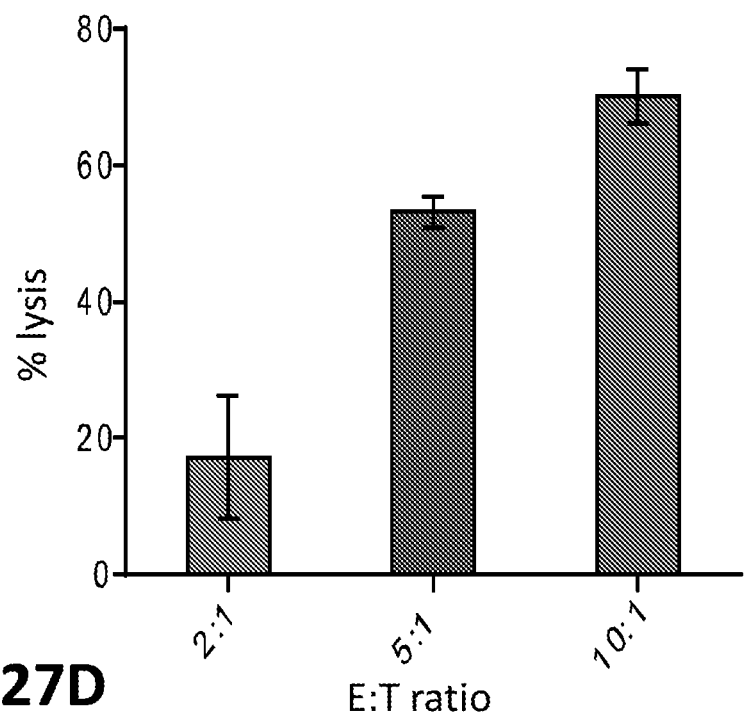
FIGURE 27D

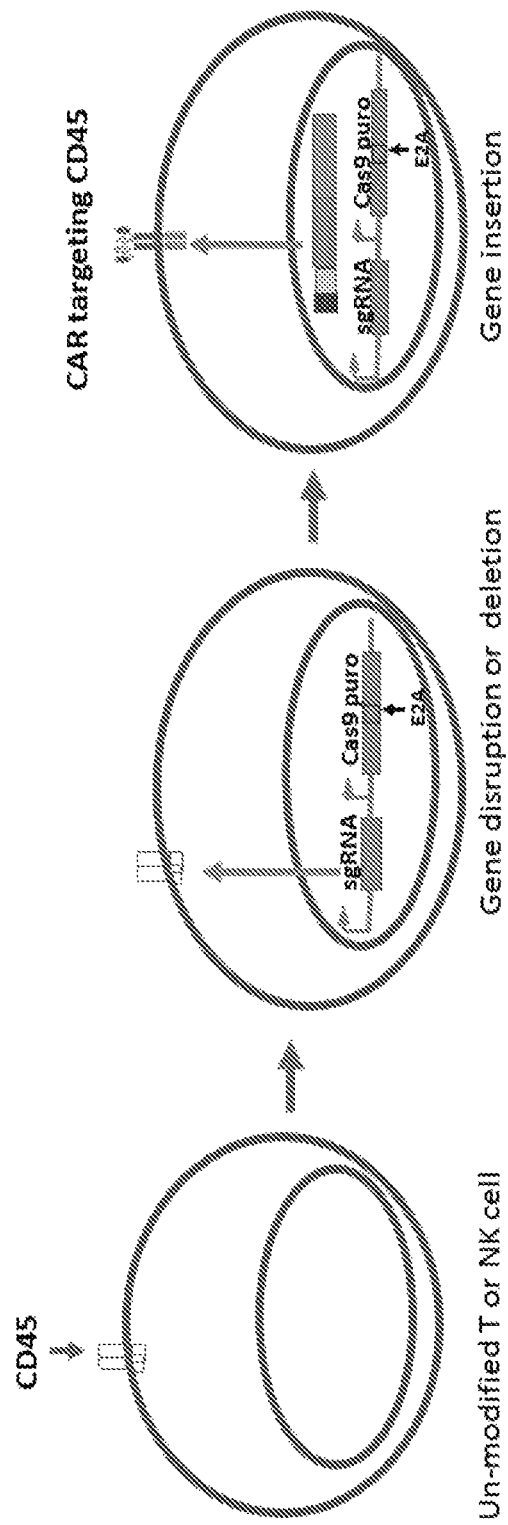

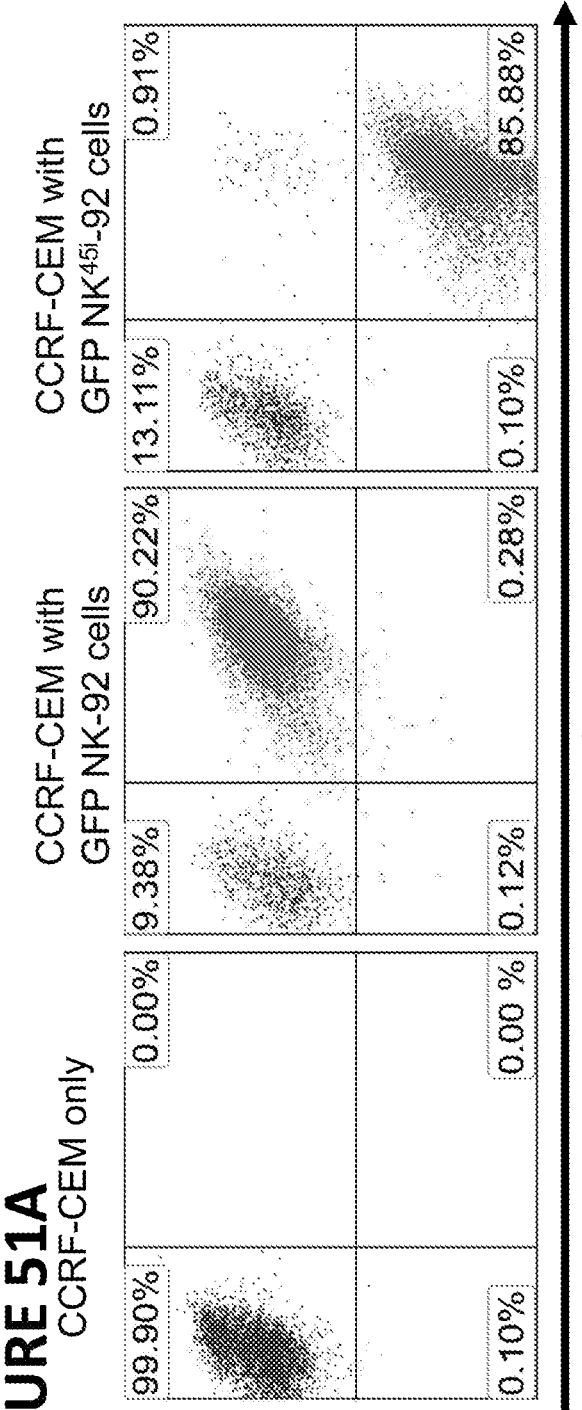
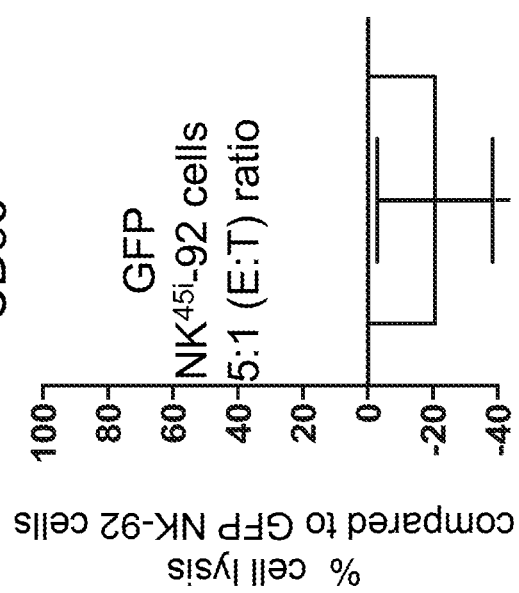
FIGURE 51A
FIGURE 51B

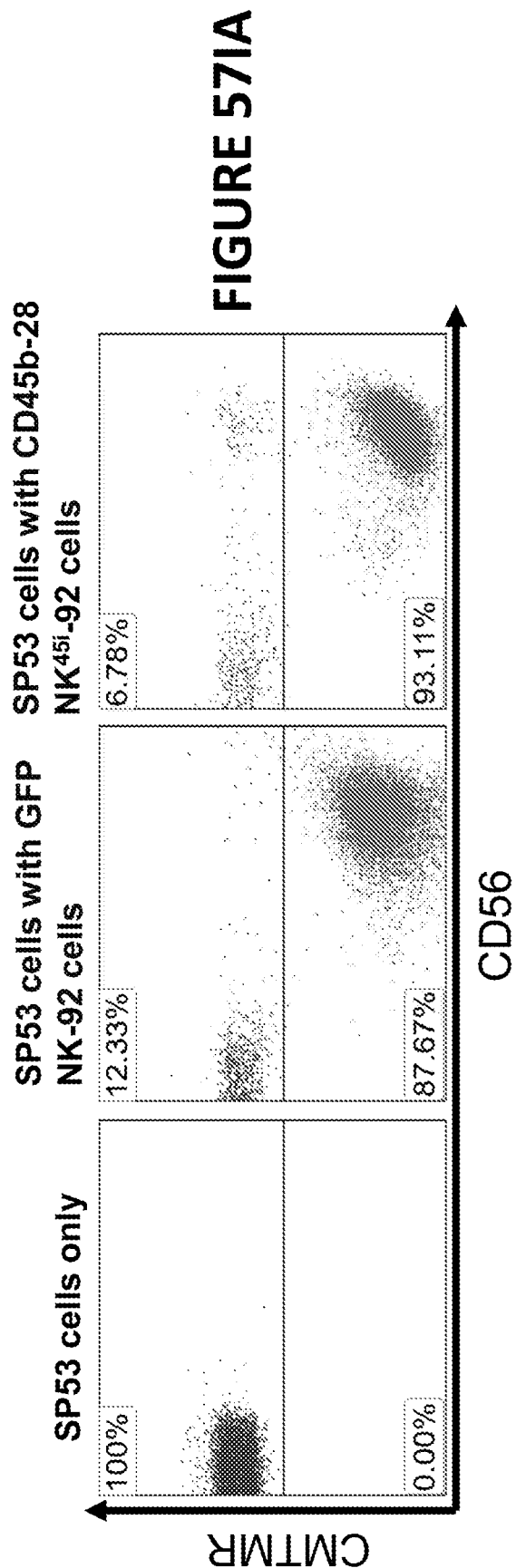
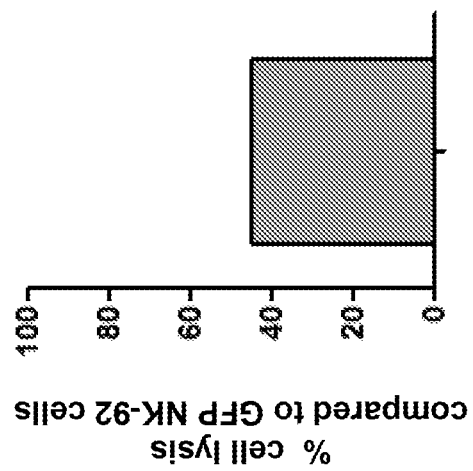
FIGURE 57IA
FIGURE 57IB

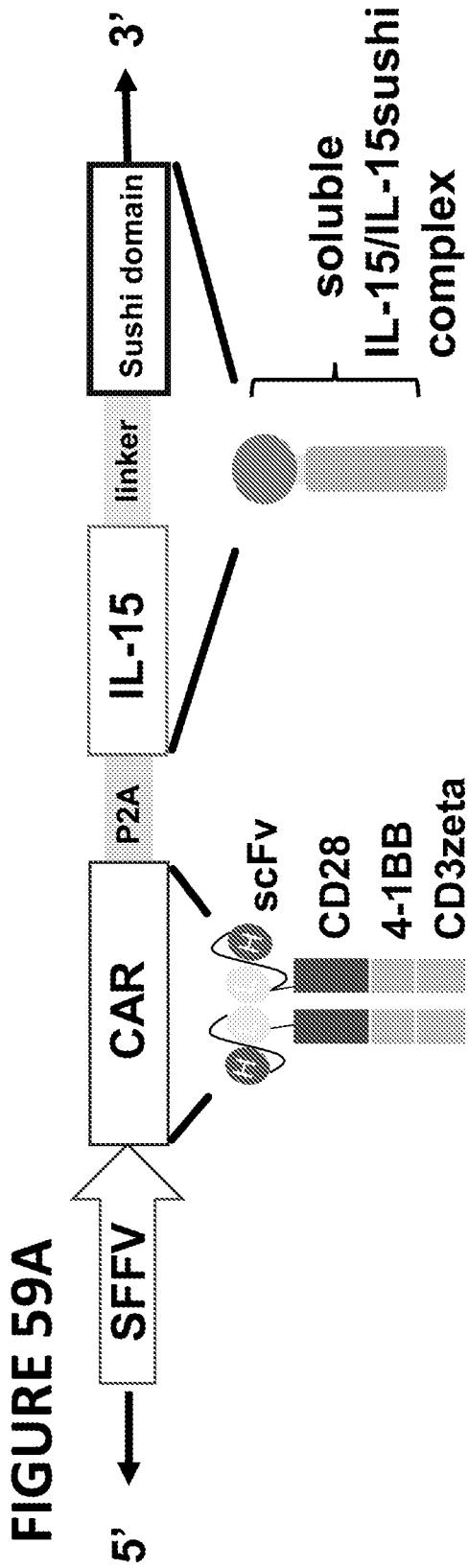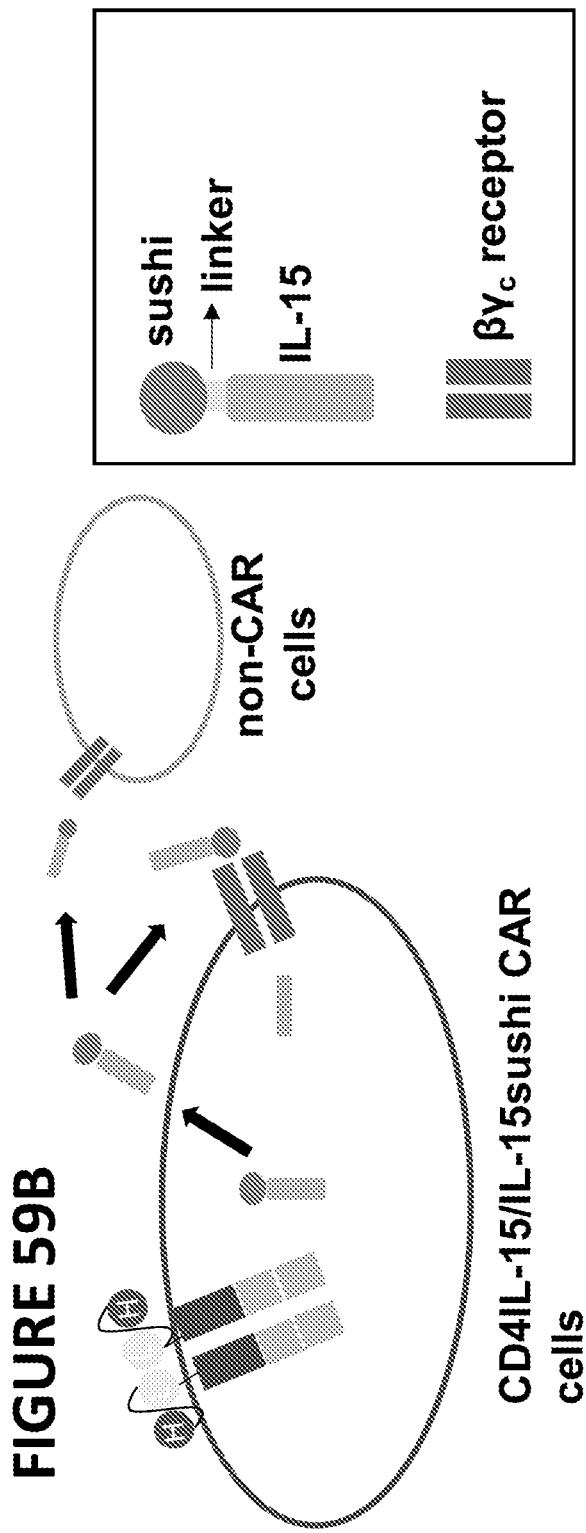
FIGURE 59A
FIGURE 59B

FIGURE 65A
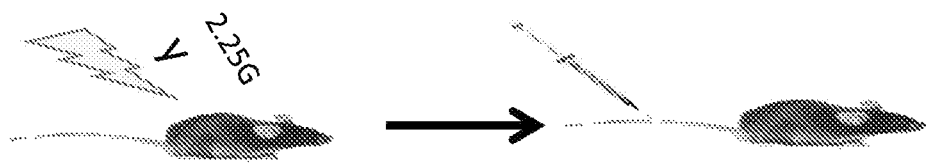
CD4 expression in AML (MOLM13) cells
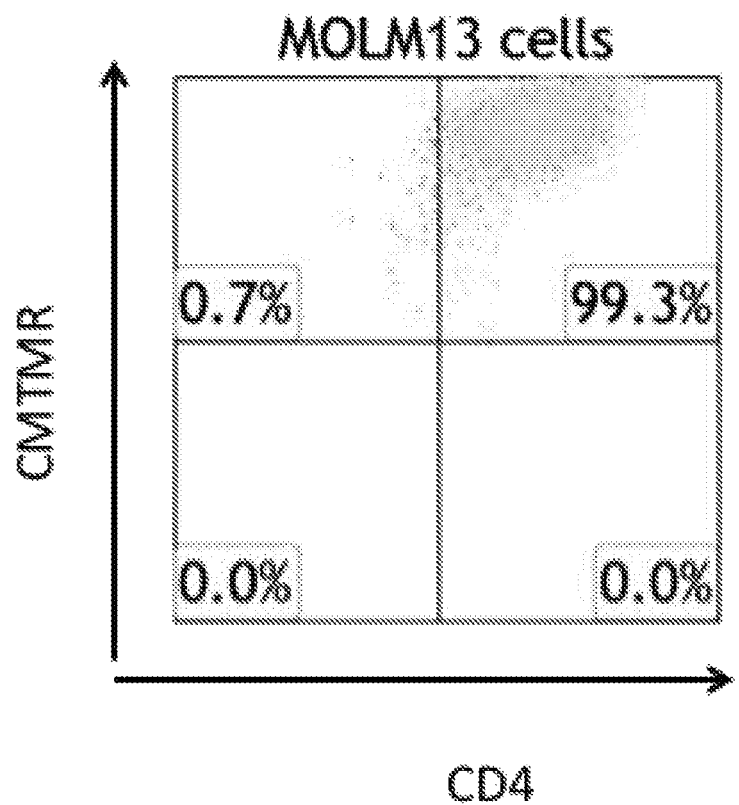

FIGURE 66A
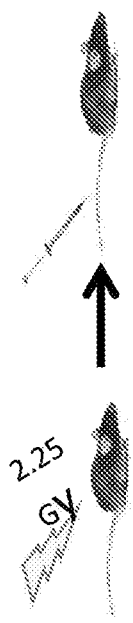
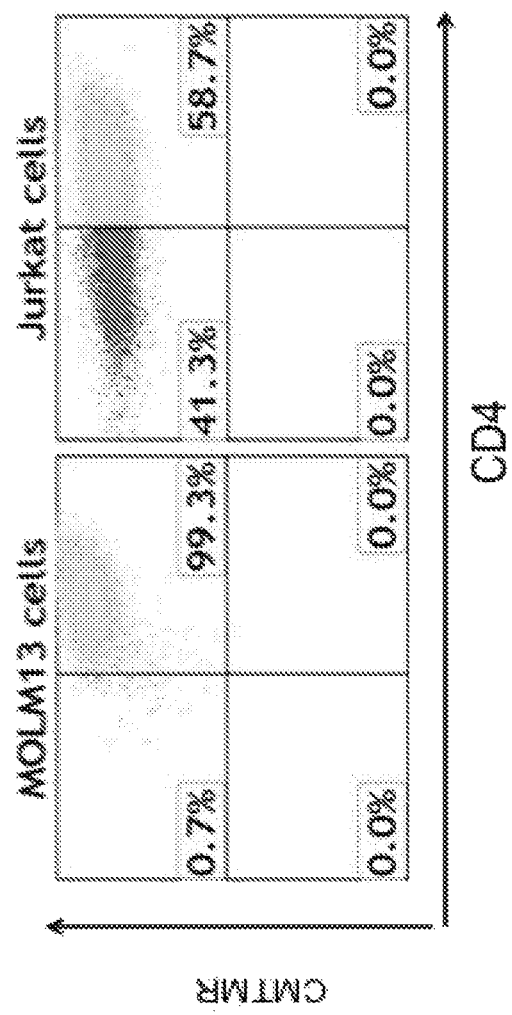
CD4 expression in MOLM13 and Jurkat cell lines

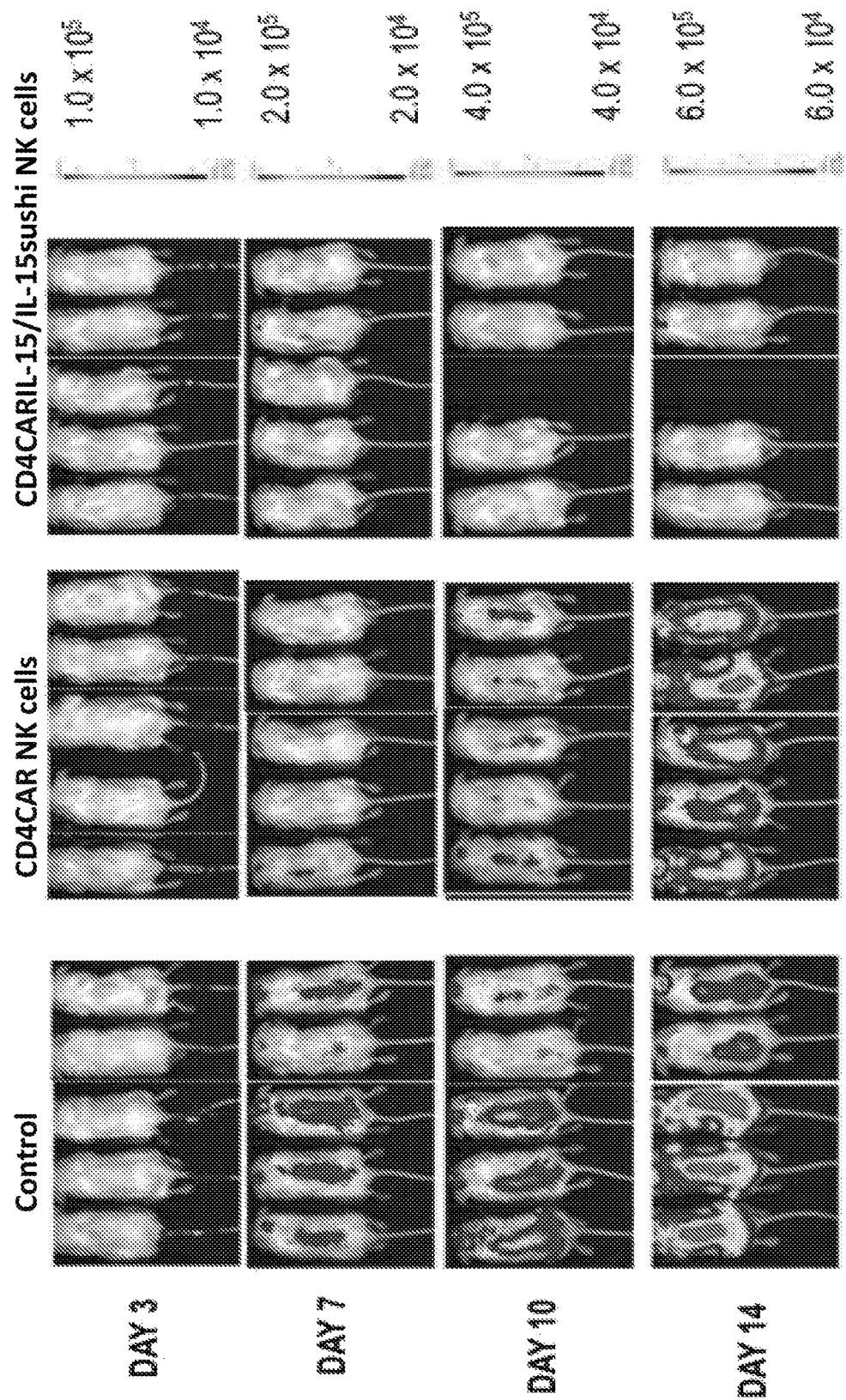

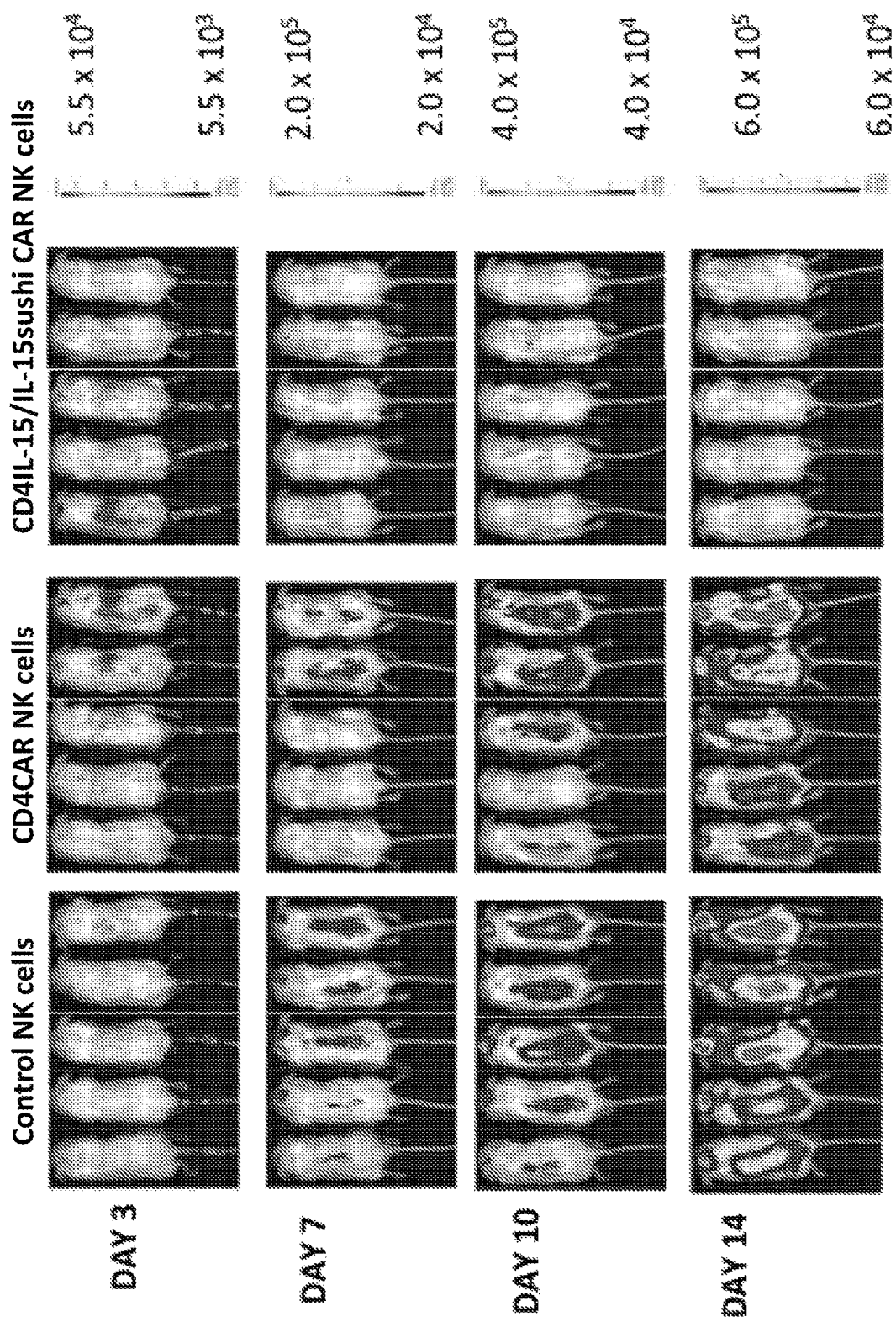

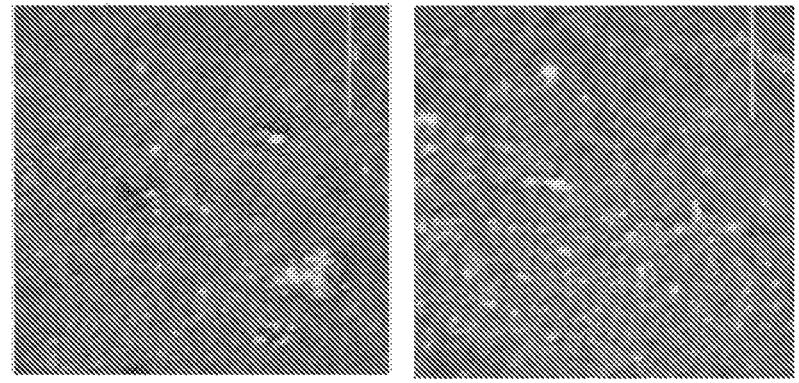
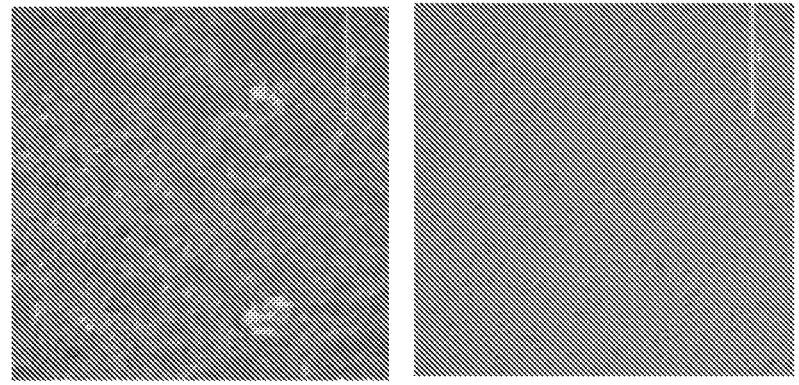
FIGURE 68A

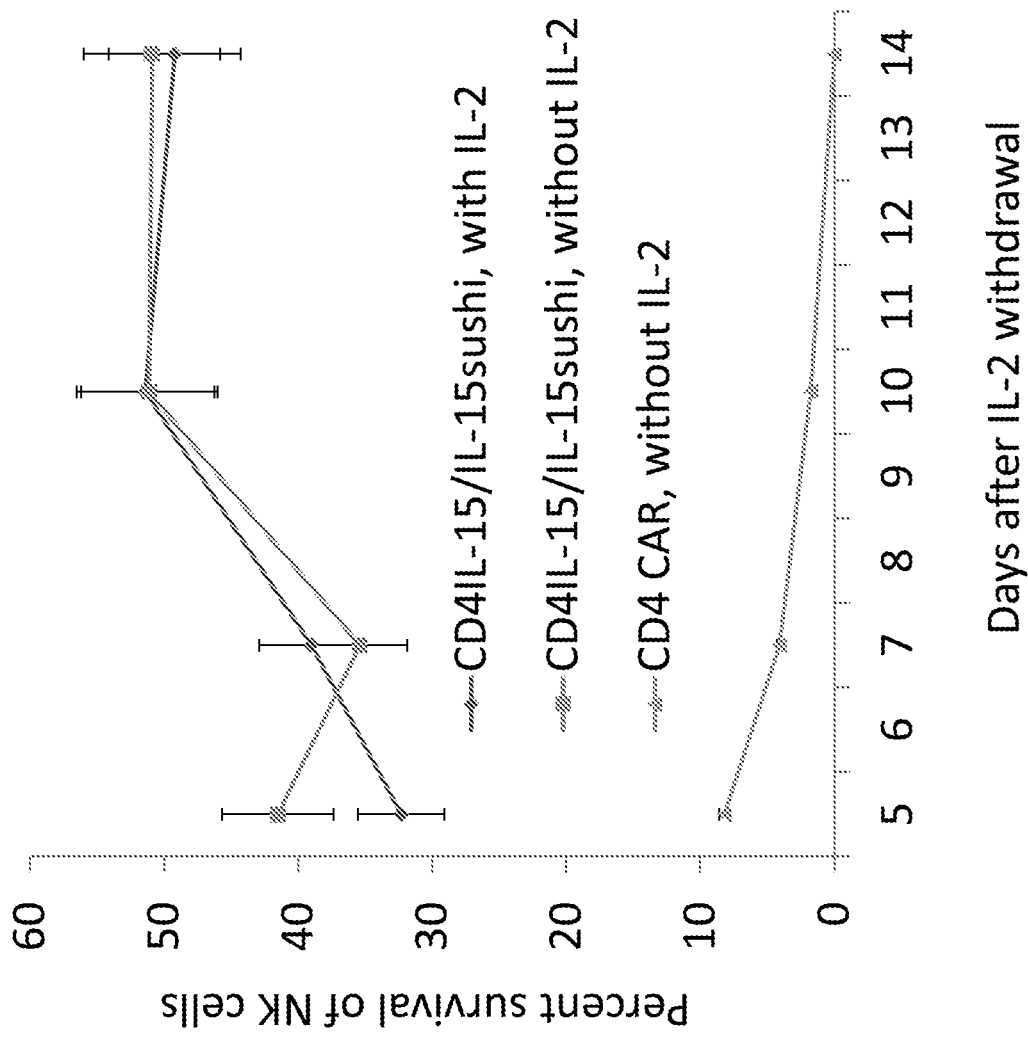

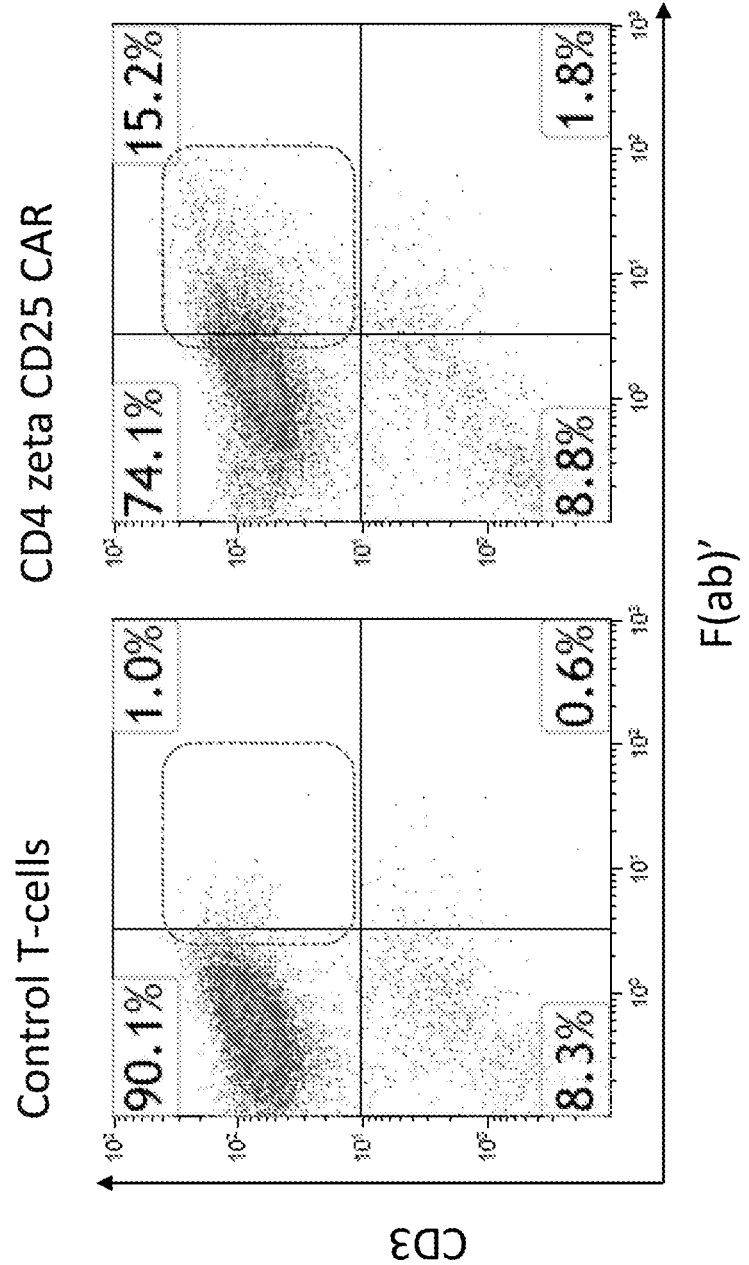

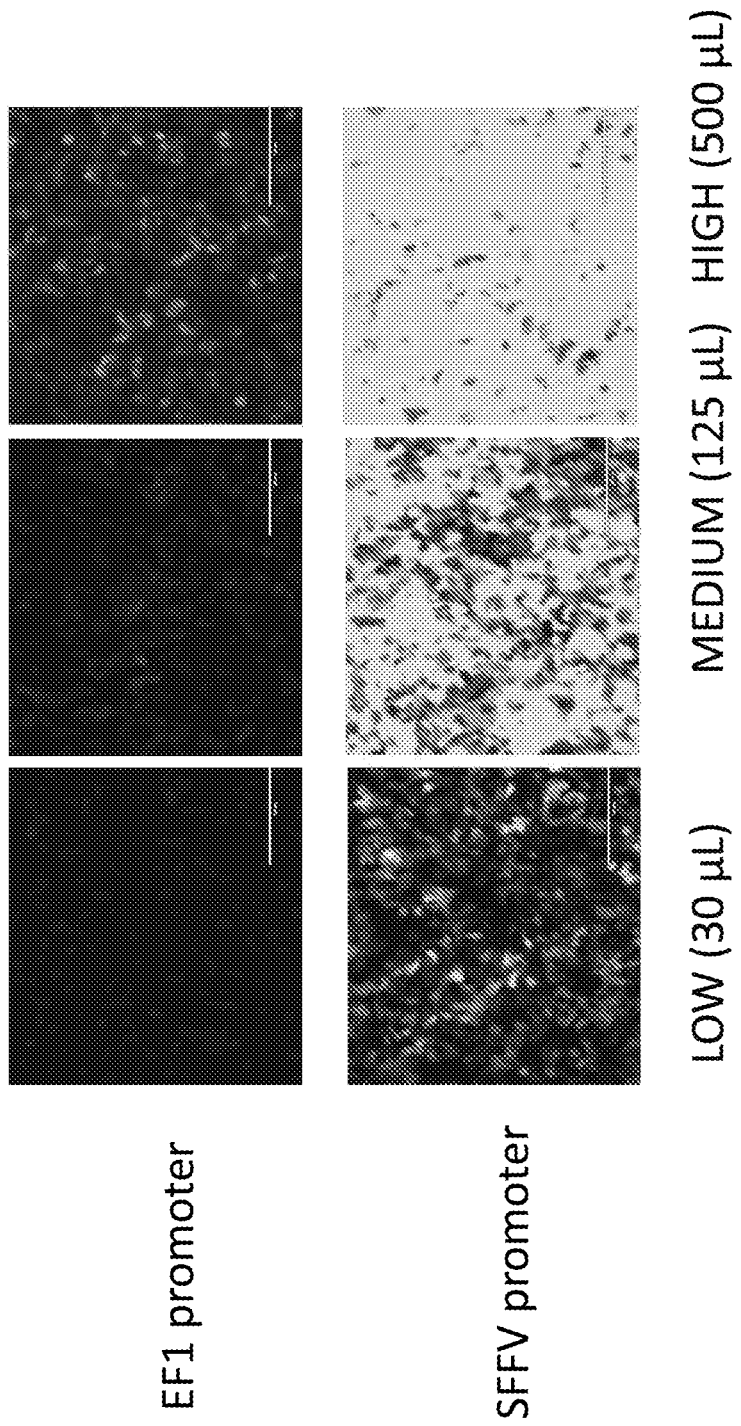

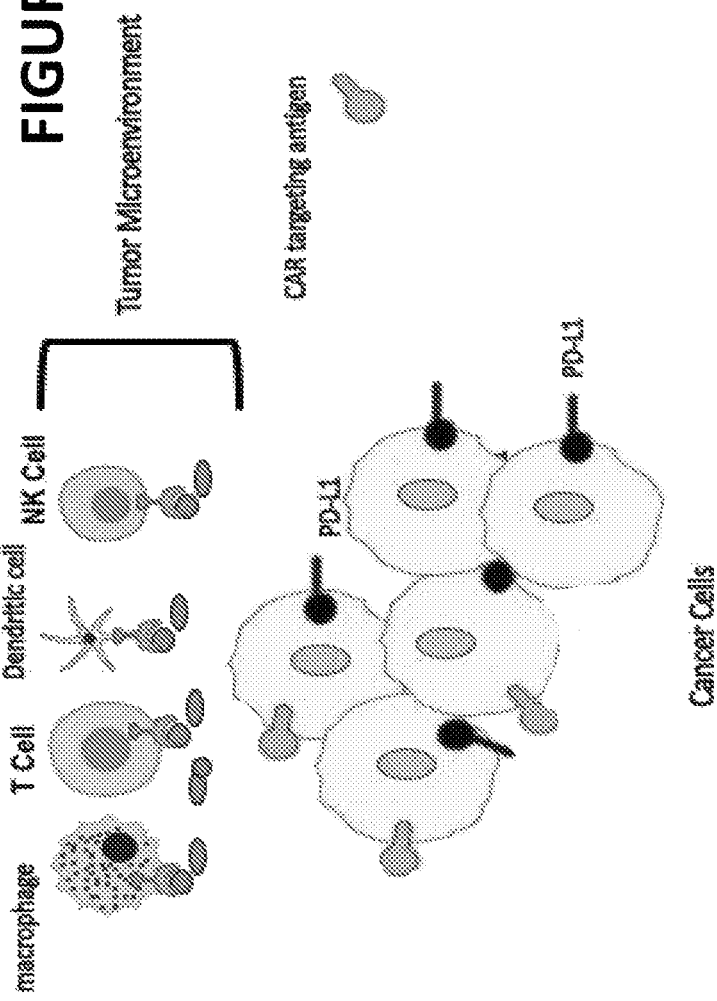
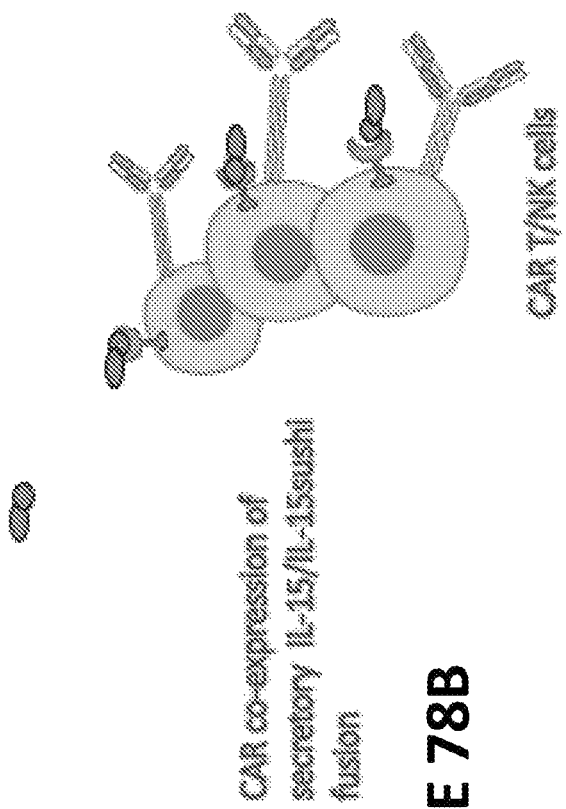
FIGURE 78A
FIGURE 78B

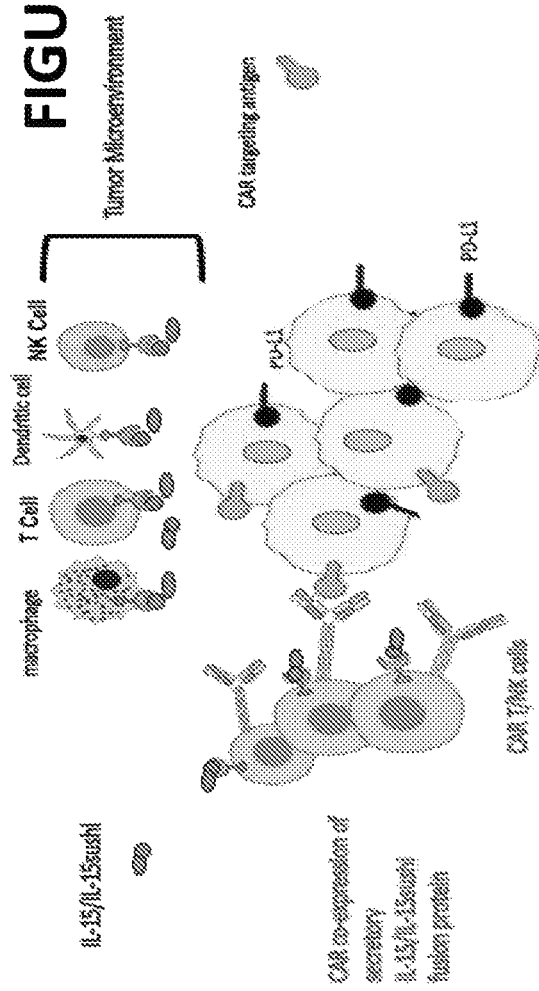
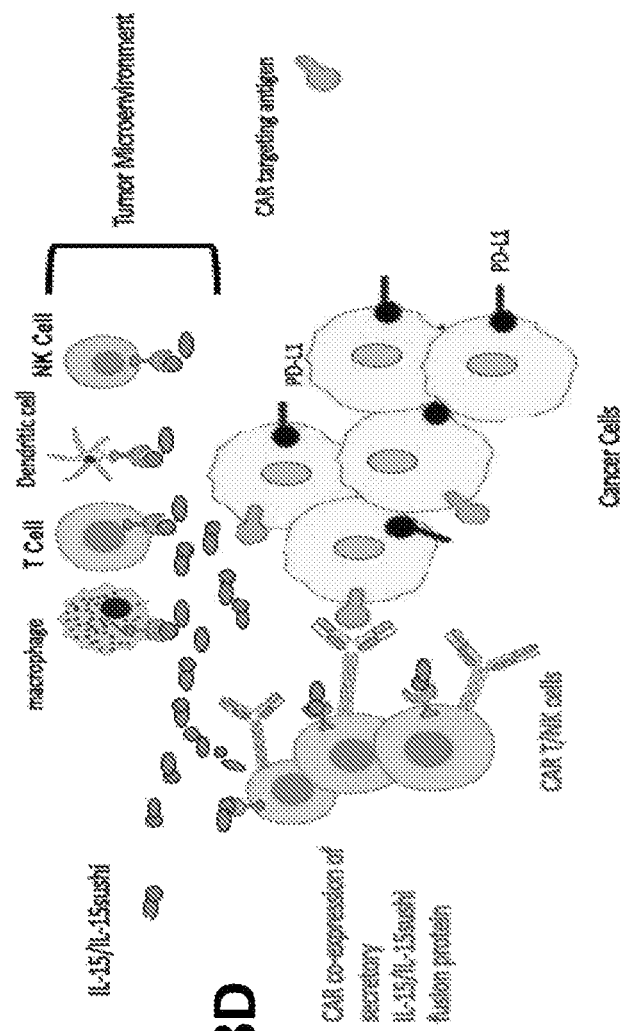
FIGURE 78C
FIGURE 78D

| | | | | | | | | | | | | | | | | |
|---|---|---|---|---|---|---|---|---|---|---|---|---|---|---|---|---|
| H. sapiens (human) | M | Y | R | M | Q | L | L | S | C | I | A | L | S | L | A | L V T N S |
| M. mulatta (rhesus) | M | Y | R | M | Q | L | L | S | C | I | A | L | S | L | A | L V T N S |
| B. taurus (bovine) | M | Y | K | I | Q | L | L | S | C | I | A | L | T | L | A | L V A N G |
| O. cuniculus (rabbit) | M | Y | K | V | Q | L | L | S | C | I | A | L | T | L | A | L T S S |
| M. musculus (mouse) | M | Y | S | M | Q | L | A | S | C | V | T | L | T | L | V | L V N S |

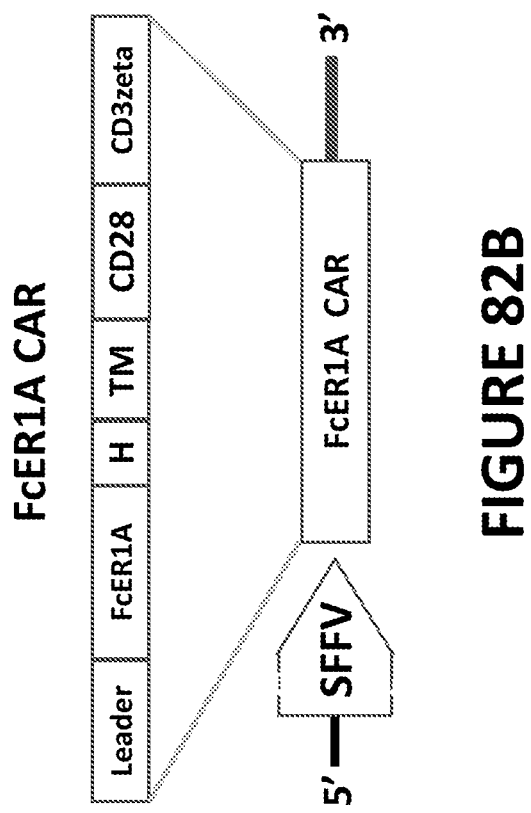

FIGURE 82C

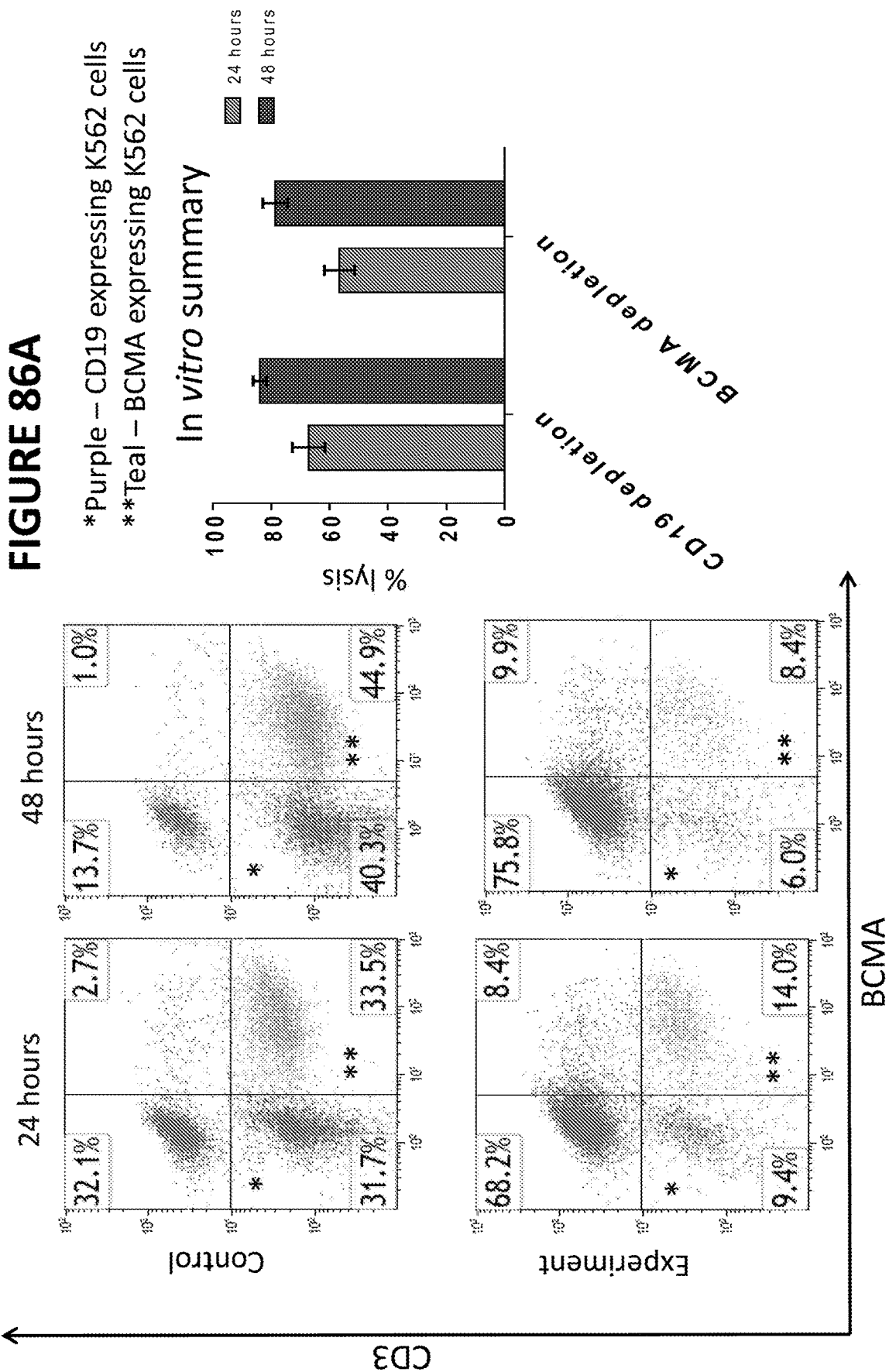

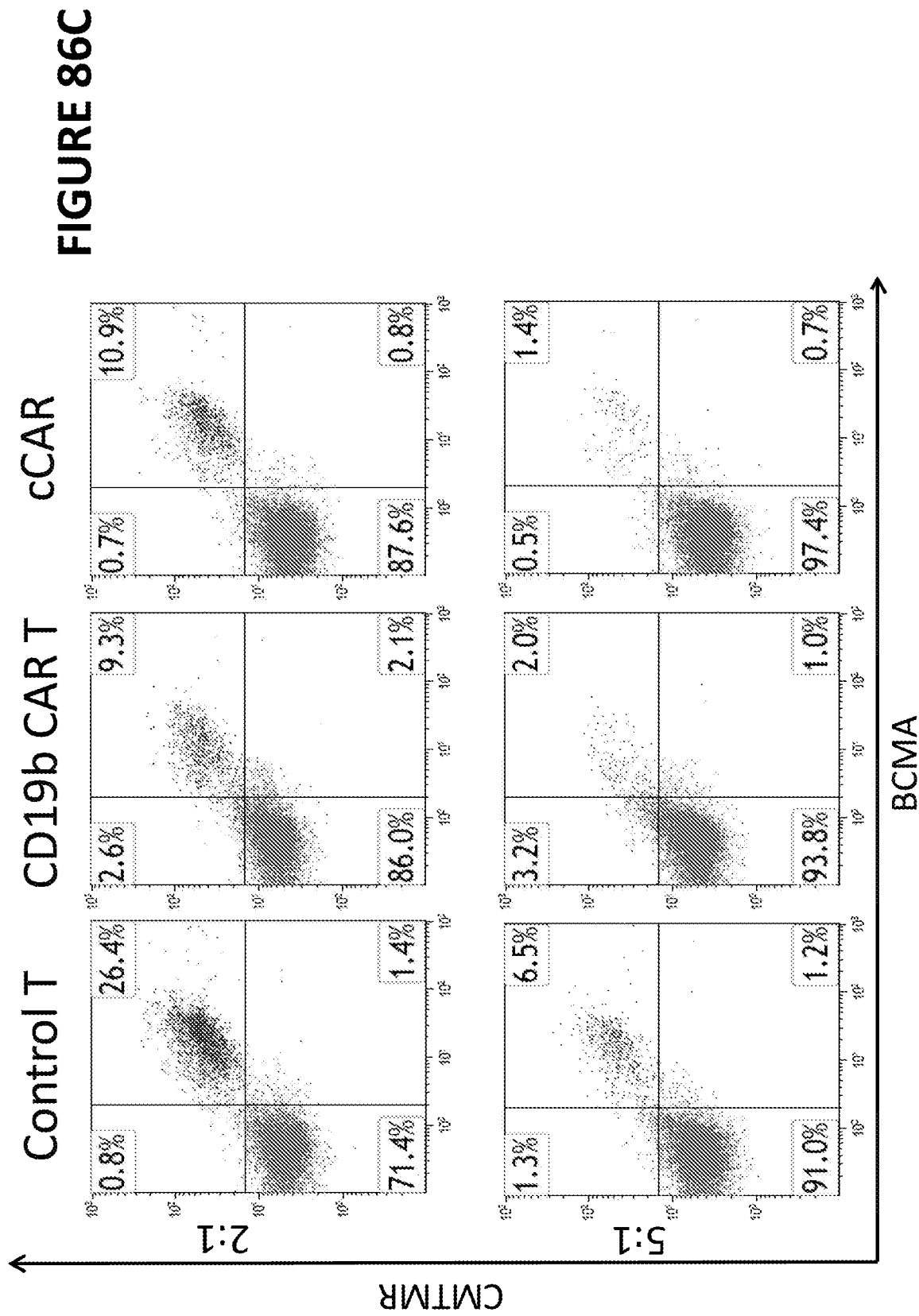

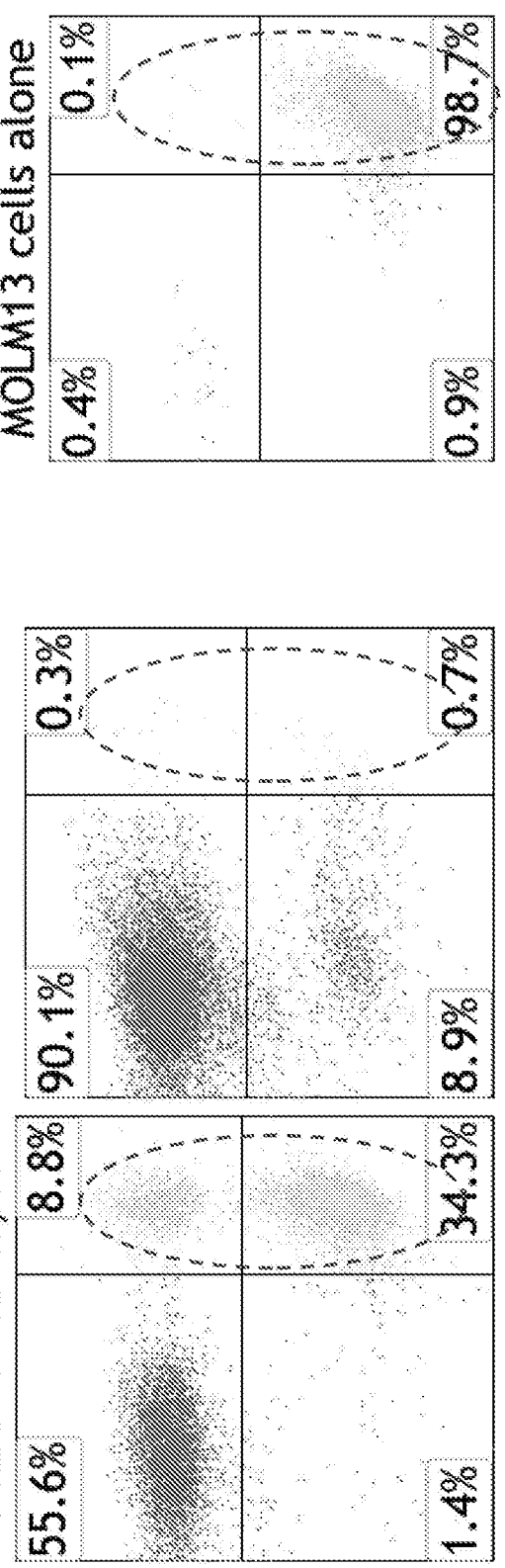
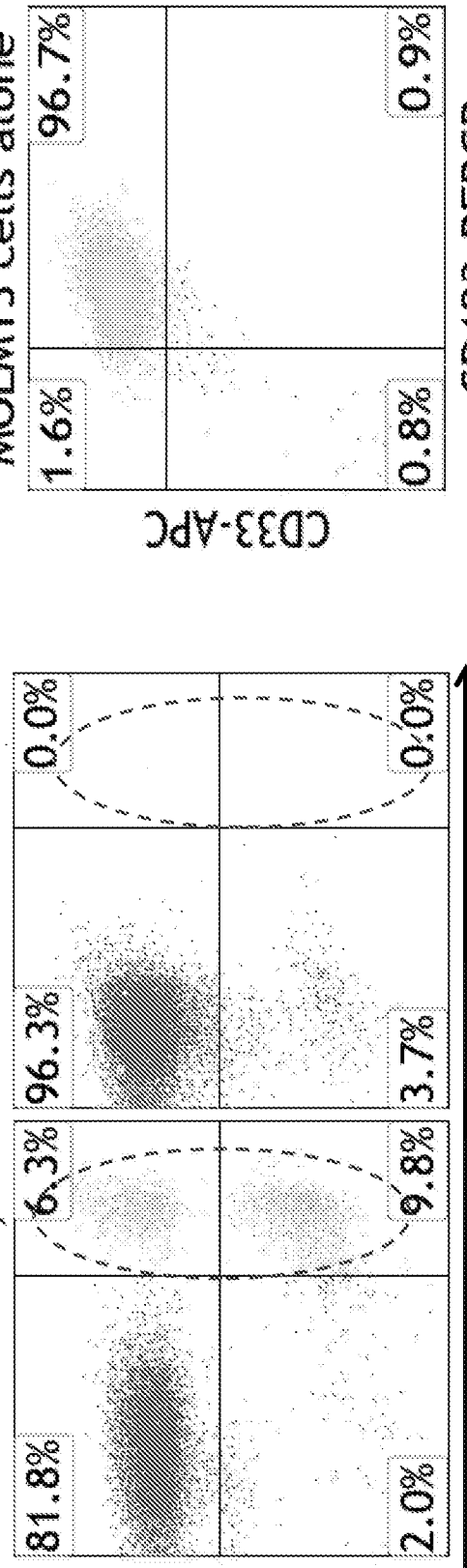
FIGURE 91C

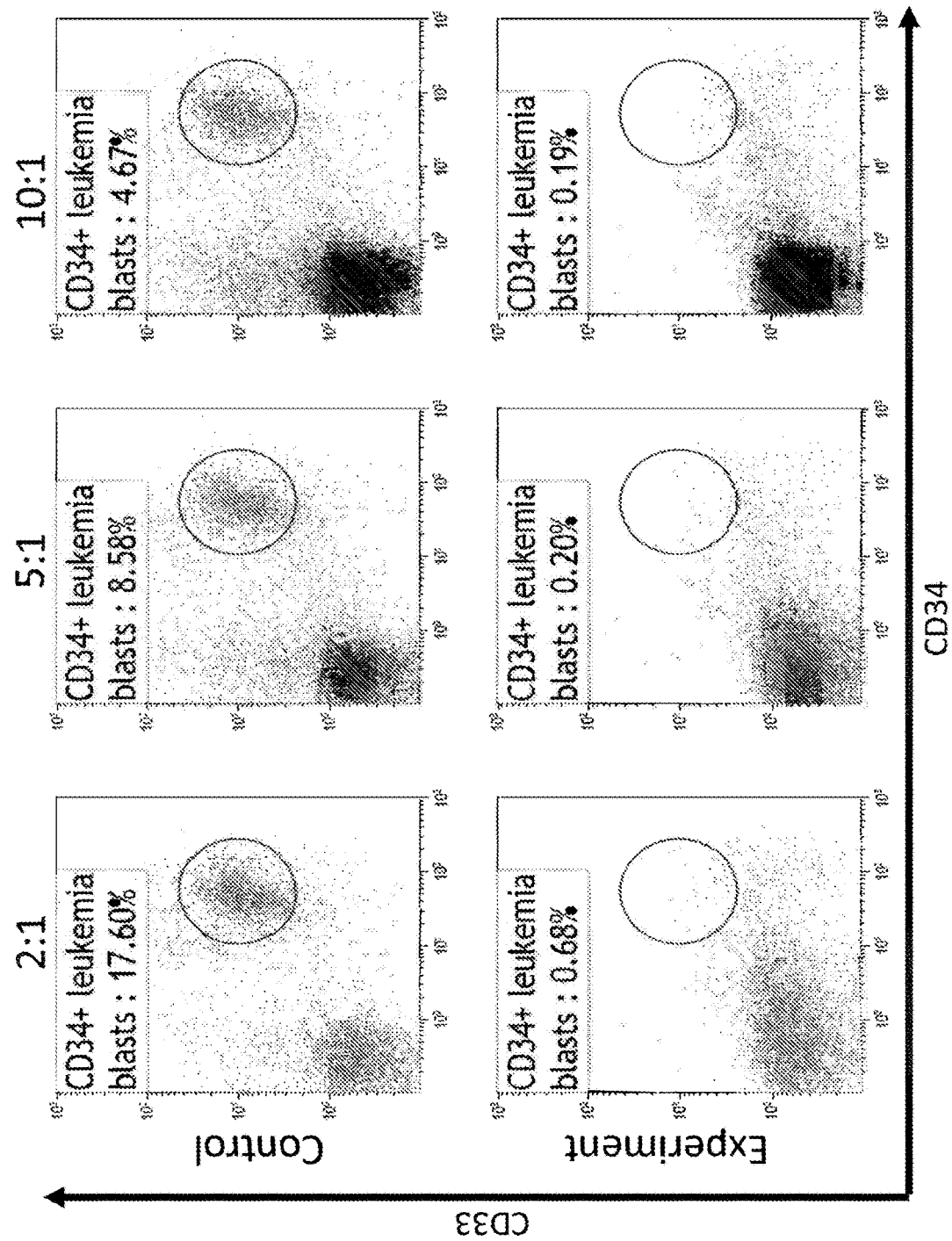

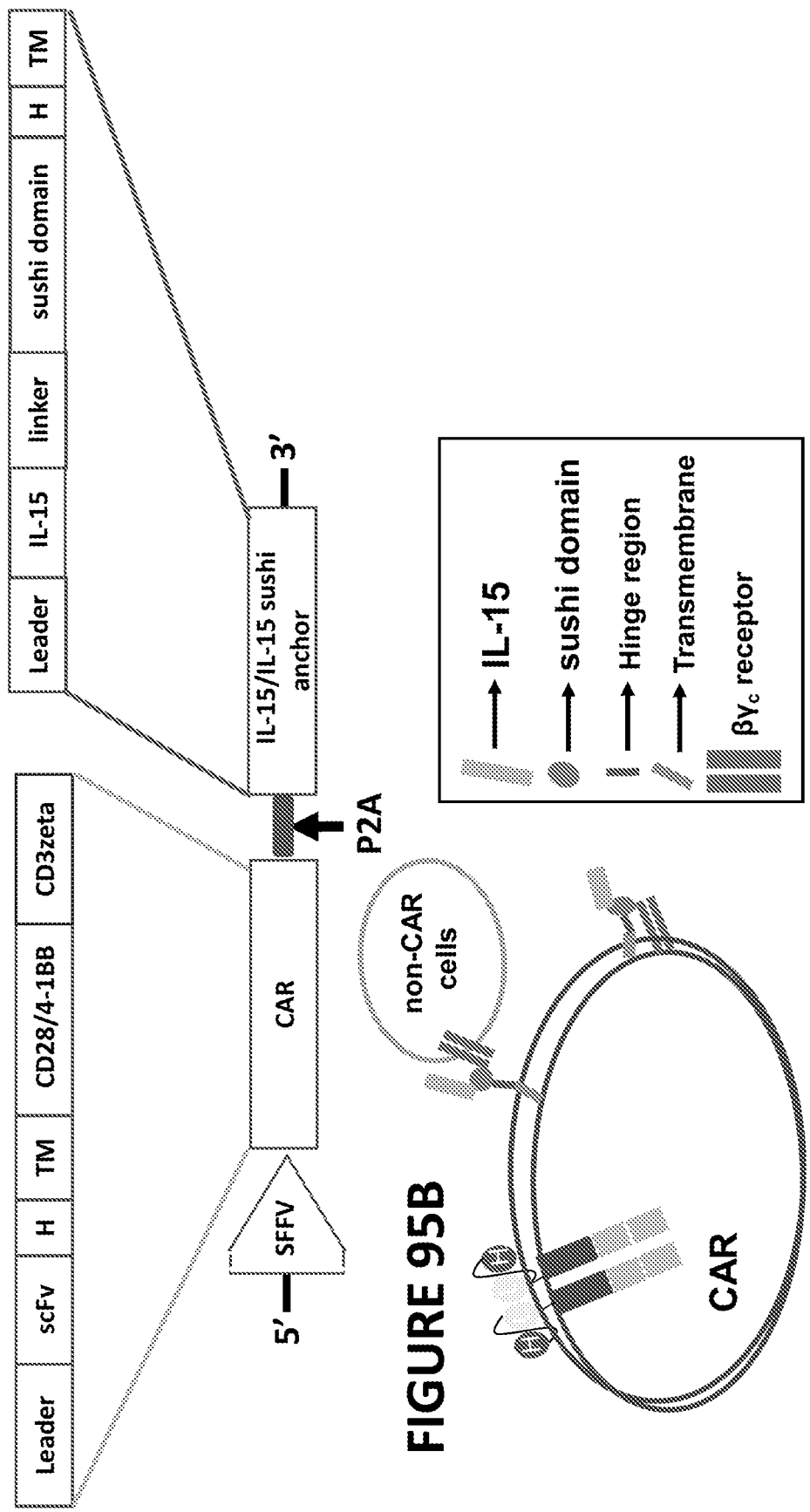

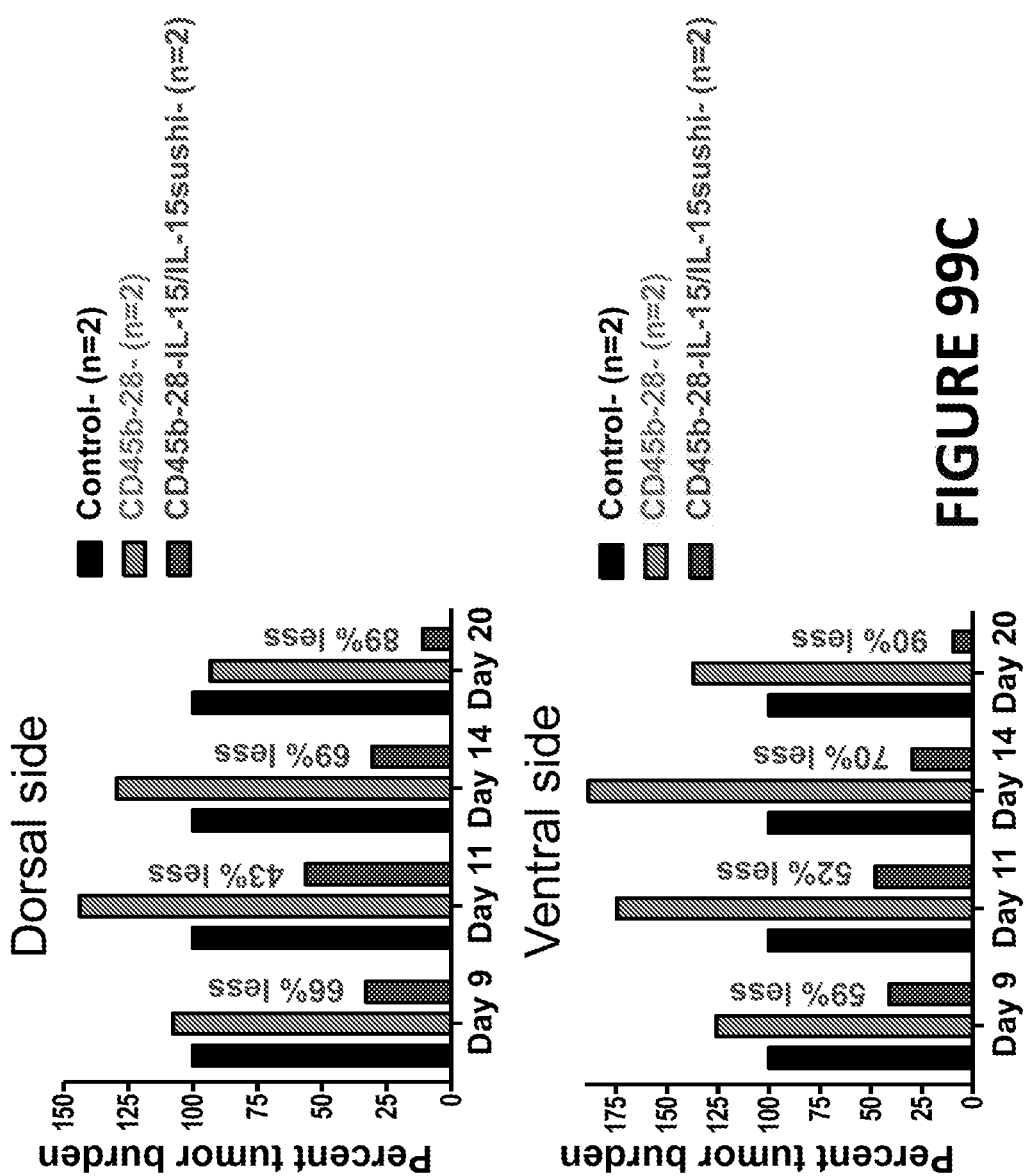

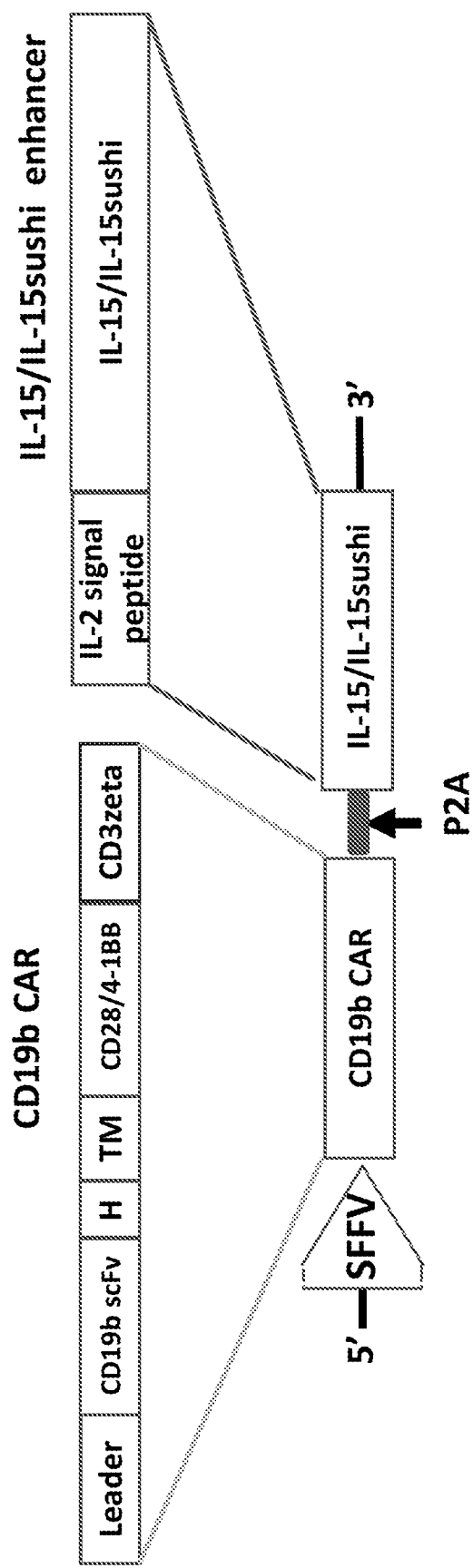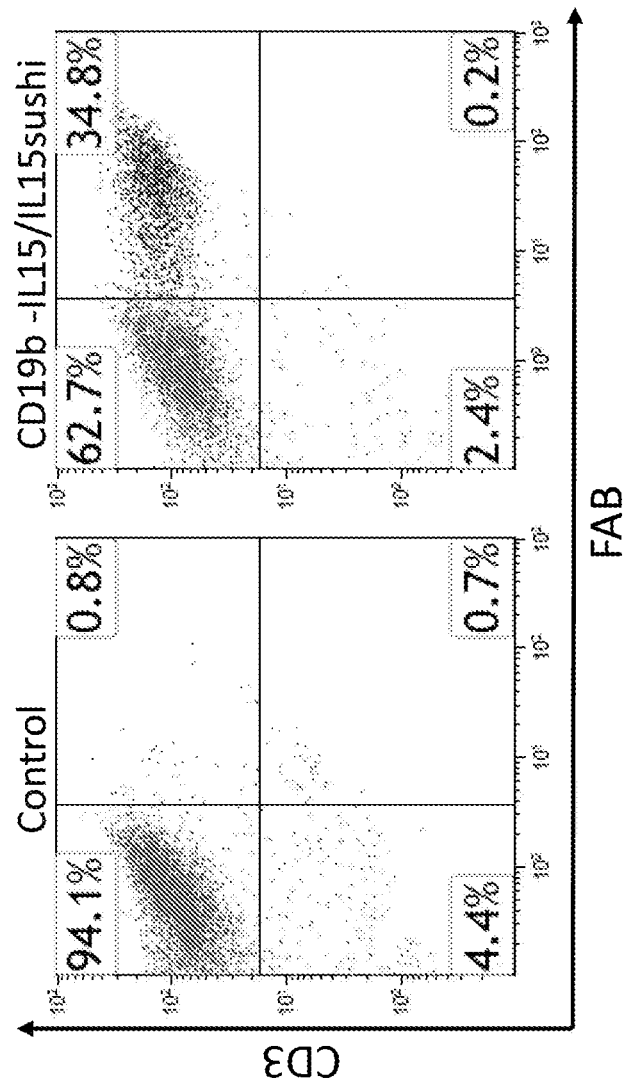
FIGURE 100A

CHIMERIC ANTIGEN RECEPTORS (CARS), COMPOSITIONS AND METHODS THEREOF

CROSS-REFERENCE TO RELATED APPLICATIONS

This application is a National Stage Application that claims a benefit of priority from Application No. PCT/US18/38529 filed Jun. 20, 2018, which claims priority to Application No. U.S. 62/523,147 filed Jun. 21, 2017 and Ser. No. 15/538,620, filed Jun. 21, 2017, the disclosures of which are herein incorporated in their entirety.

BACKGROUND

T cells, a type of lymphocyte, play a central role in cell-mediated immunity. They are distinguished from other lymphocytes, such as B cells and natural killer cells (NK cells), by the presence of a T-cell receptor (TCR) on the cell surface. T helper cells, also called CD4+ T or CD4 T cells, express CD4 glycoprotein on their surface. Helper T cells are activated when exposed to peptide antigens presented by MHC (major histocompatibility complex) class II molecules. Once activated, these cells proliferate rapidly and secrete cytokines that regulate immune response. Cytotoxic T cells, also known as CD8+ T cells or CD8 T cells, express CD8 glycoprotein on the cell surface. The CD8+ T cells are activated when exposed to peptide antigens presented by MHC class I molecules. Memory T cells, a subset of T cells, persist long term and respond to their cognate antigen, thus providing the immune system with "memory" against past infections and/or tumor cells.

T cells can be genetically engineered to produce special receptors on their surface called chimeric antigen receptors (CARs). CARs are proteins that allow the T cells to recognize a specific protein (antigen) on tumor cells. These engineered CAR T cells are then grown in the laboratory until they number in the billions. The expanded population of CAR T cells is then infused into the patient.

Clinical trials to date have shown chimeric antigen receptor (CAR) T cells to have great promise in hematologic malignancies resistant to standard chemotherapies. Most notably, CD19-specific CAR (CD19CAR) T-cell therapies have had remarkable results including long-term remissions in B-cell malignancies (Kochenderfer, Wilson et al. 2010, Kalos, Levine et al. 2011, Porter, Levine et al. 2011, Davila, Riviere et al. 2013, Grupp, Frey et al. 2013, Grupp, Kalos et al. 2013, Kalos, Nazimuddin et al. 2013, Kochenderfer, Dudley et al. 2013, Kochenderfer, Dudley et al. 2013, Lee, Shah et al. 2013, Park, Riviere et al. 2013, Maude, Frey et al. 2014).

Despite the success of CAR therapy in B-cell leukemia and lymphoma, the application of CAR therapy to T-cell malignancies has not yet been well established. Given that T-cell malignancies are associated with dramatically poorer outcomes compared to those of B-cell malignancies (Abramson, Feldman et al. 2014), CAR therapy in this respect has the potential to further address a great clinical need.

To date, current efforts have focused on CAR T-cells demonstrating efficacy in various B-cell malignancies. While initial remission rates of approximately 90% are common in B-ALL using CD19CAR, most of these relapse within a year. The relapse is at least in part due to the antigen escape. Thus, more effective CAR T cell treatments in order to prevent the relapse are urgently needed. Target discovery and selection are the initial step as there are no general rules to ensure or guide CAR design that are efficacious.

There are some roadblocks that hinder the broader adoption of CAR therapeutic approach. Among the most general challenges are: (1) selection of antigen target and chimeric antigen receptor(s); (2) CAR design; (3) tumor heterogeneity, particularly the variance in the surface expression of tumor antigens. Targeting single antigen carries the risk of immune escape and this could be overcome by targeting multiple desired antigens; (4) immunosuppressive microenvironment. CAR T cells may be suppressed and de-activated on arrival at the tumor site.

Most CAR chimeric antigen receptors are scFvs derived from monoclonal antibodies and some of these monoclonal antibodies have been used in the clinical trials or treatment for diseases. However, they have limited efficacy, which suggests that alternative and more potent targeting approaches, such as CARs are required. scFvs are the most commonly used chimeric antigen receptor for CARs. However, CAR affinity binding and locations of the recognized epitope on the antigen could affect the function. Additionally the level of the surface CAR expression on the T cells or NK cells is affected by an appropriate leader sequence and promoter. Furthermore, overexpressed CAR proteins can be toxic to cells.

Therefore, there remains a need for improved chimeric antigen receptor-based therapies that allow for more effective, safe, and efficient targeting of T-cell associated malignancies.

SUMMARY OF THE INVENTION

In one embodiment, the present disclosure provides an engineered cell including a chimeric antigen receptor polypeptide comprising a signal peptide, antigen recognition domain, a hinge region, a transmembrane domain, a signaling domain, and a co-stimulatory domain; wherein said antigen recognition domain comprises one of FcER1A, FcER1, Ig E, CD19, BCMA, or CD45.

In another embodiment, the present disclosure provides an engineered polypeptide including a chimeric antigen receptor polypeptide including a signal peptide, antigen recognition domain, a hinge region, a transmembrane domain, a signaling domain, and a co-stimulatory domain; wherein said antigen recognition domain includes one of FcER1A, CD19, BCMA, or CD45; and at least one enhancer; wherein a high efficiency cleavage site is disposed between the chimeric antigen receptor polypeptide and enhancer.

In another embodiment, the present disclosure provides an engineered cell including a first chimeric antigen receptor polypeptide including a first signal peptide, first antigen recognition domain, a first hinge region, a first transmembrane domain, a first signaling domain, and a first co-stimulatory domain; and a second chimeric antigen receptor polypeptide including a second signal peptide, second antigen recognition domain, a second hinge region, a second transmembrane domain, a second signaling domain, and a second co-stimulatory domain; wherein the first antigen recognition domain and second antigen recognition domain are different; and the first antigen recognition domain and second antigen rejection domain are selected from the group consisting of CD4, CD19, CD33, CD123, CLL-1, BAFFR, BCMA, and CS-1.

In another embodiment, the present disclosure provides an engineered polypeptide including a first chimeric antigen receptor polypeptide including a first signal peptide, first antigen recognition domain, a first hinge region, a first transmembrane domain, a first signaling domain, and a first co-stimulatory domain; and a second chimeric antigen receptor polypeptide including a second signal peptide, second antigen recognition domain, a second hinge region, a second transmembrane domain, a second signaling domain, and a second co-stimulatory domain; wherein the first antigen recognition domain and the second antigen recognition domain are different; and the first antigen recognition domain and second antigen rejection domain are selected from the group consisting of CD4, CD19, CD33, CD123, BAFFR, CLL-1, BCMA, and CS-1.

In another embodiment, the present disclosure provides a method of treating an autoimmune disease, said method including administering an engineered cell described above to a patient in need thereof; wherein said autoimmune disease comprises systemic lupus erythematosus (SLE), multiple sclerosis (MS), Inflammatory bowel disease (IBD), Rheumatoid arthritis, Sjögren syndrome, dermatomyosities, autoimmune hemolytic anemia, Neuromyelitis optica (NMO), NMO Spectrum Disorder (NMOSD), idiopathic thrombocytopenic purpura (ITP), antineutrophil cytoplasmic autoantibodies (ANCAs) associated with systemic autoimmune small vessel vasculitis syndromes or microscopic polyangiitis (MPA), granulomatosis with polyangiitis (GPA, Wegener's granulomatosis), or eosinophilic granulomatosis with polyangiitis (EGPA, Churg-Strauss syndrome).

In another embodiment, the present disclosure provides a method of treating asthma. The method includes administering an engineered cell described above.

In another embodiment, the present disclosure provides a method of treating organ rejection. The method includes administering an engineered cell described above.

In one embodiment, the present disclosure provides an engineered cell having a first chimeric antigen receptor polypeptide including a first antigen recognition domain, a first signal peptide, a first hinge region, a first transmembrane domain, a first co-stimulatory domain, and a first signaling domain; and a second chimeric antigen receptor polypeptide including a second antigen recognition domain, a second signal peptide, a second hinge region, a second transmembrane domain, a second co-stimulatory domain, and a second signaling domain; wherein the first antigen recognition domain is different than the second antigen recognition domain.

In another embodiment, the present disclosure provides an engineered polypeptide including a chimeric antigen receptor and an enhancer.

In another embodiment, the present disclosure provides an engineered polypeptide including a chimeric antigen receptor polypeptide and an enhancer.

In another embodiment, the present disclosure provides an engineered chimeric antigen receptor polypeptide, the polypeptide including: a signal peptide, a CD45 antigen recognition domain, a hinge region, a transmembrane domain, at least one co-stimulatory domain, and a signaling domain. In another embodiment, the present disclosure provides a polynucleotide encoding for the aforementioned polypeptide.

In another embodiment, the present disclosure provides an engineered cell having the engineered polypeptide or polynucleotide described above.

In another embodiment, the present disclosure provides a method of reducing the number of target cells including the steps of (i.) contacting said target cells with an effective amount of an engineered cell having at least one chimeric antigen receptor polypeptide, for engineered cells having multiple chimeric antigen receptor polypeptides, each chimeric antigen receptor polypeptide is independent; and (ii.) optionally, assaying for the reduction in the number of said cells. The target cells include at least one cell surface antigen selected from the group consisting of interleukin 6 receptor, ROR1, PSMA, PSCA, MAGE A3, Glycolipid, glypican 3, F77, GD-2, WT1, CEA, HER-2/neu, IL13Rα2, Met, mesothelin, EGFR, EGFRvIII, MUC16, NKG2D ligands, thyroglobulin, MAGE-3, MAGE-4, MAGE-5, MAGE-6, alpha-fetoprotein, CA 19-9, CA 72-4, NY-ESO, FAP, ErbB, c-Met, MART-1, MUC1, MUC2, MUC3, MUC4, MUC5, CD30, EGFRvIII, CD33, CD123, CLL-1, immunoglobin kappa and lambda, CD38, CD52, CD19, CD20, CD22, CD38, CD45, BCMA, CS1, BAFF receptor, TACI, CD3, CD4, CD8, CD5, CD7, CD2, CD45, CD70 and CD138.

In another embodiment, the present disclosure provides methods for treating B-cell lymphoma, T-cell lymphoma, Hodgkin's lymphoma, multiple myeloma, acute myeloid leukemia, chronic myeloid leukemia, chronic myeloproliferative neoplasms, myelodysplastic syndromes, granulocytic sarcoma, histiocytic sarcoma, B-cell acute lymphoblastic leukemia (B-ALL), blastic plasmacytoid dendritic cell neoplasm (BPDCN), chronic myelomonocytic leukemia, and cell proliferative diseases by administering any of the engineered cells described above to a patient in need thereof.

In some embodiments, the disclosed invention comprises methods and compositions of controlling the proliferation of T cells, for instance, CAR T cells or therapeutic T cells using CAMPATH. The methods further relate to compositions and methods for ablating CAR T cells using CAMPATH after tumor depletion or in emergency cases, for example, unexpected side effects caused by CAR Therapy. In further embodiments, CD52 is incorporated into CD5 CAR engineered cell or any CAR engineered cell and can be used as a "safety switch" for CAR therapy.

cells to gauge maximum transduction efficiency before usage on UCB (umbilical cord blood) and PB (peripheral blood) T-cells. Lower panel shows CD33CD123 cCAR (also referred to as CD33CD123-2G-CAR) T-cells transduced with lentiviral vectors comprising CD33CD123 cCAR construct and GFP-transduced cells as control Percentages indicated by yellow circles are proxies for transduction efficiency.

Figure 3:
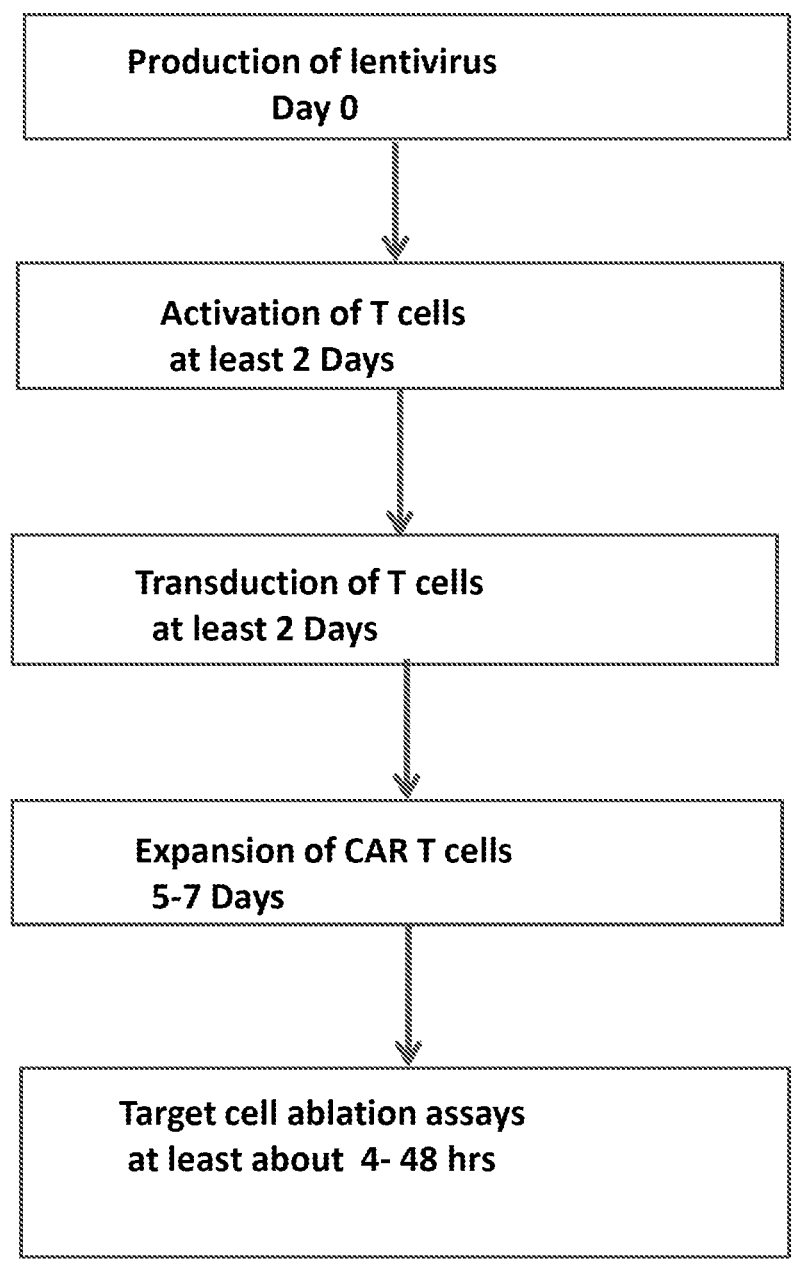

FIG. 3. Schematic showing a method of generating a high-efficiency compound CAR (cCAR). HEK-293-FT cells are transfected with compound CAR plasmid DNA and lipofectamine 2000; viral supernatant collected at about 36 hr and at about 60 h; filtered and stored at −80° C. T cells are activated with anti-mouse CD3 antibody and IL-2 for at least 2 days. Activated T cells are transduced at least once with thawed lentivirus on retronectin-coated plates; after at least one overnight transductions at 0.3×106 T cells/mL for about 2 days, the number of T cells was reduced in order to increase transduction efficiency. After transduction, cells are washed and expanded; flow analysis (F(Ab')2 labeling) is done to confirm CAR efficiency on day 3; total 5-7 day expansion. cCAR T cells are co-cultured with target cells in vitro and cCAR T cells killing efficacy of cancer cells is assessed in vivo (mice).

Figure 4:
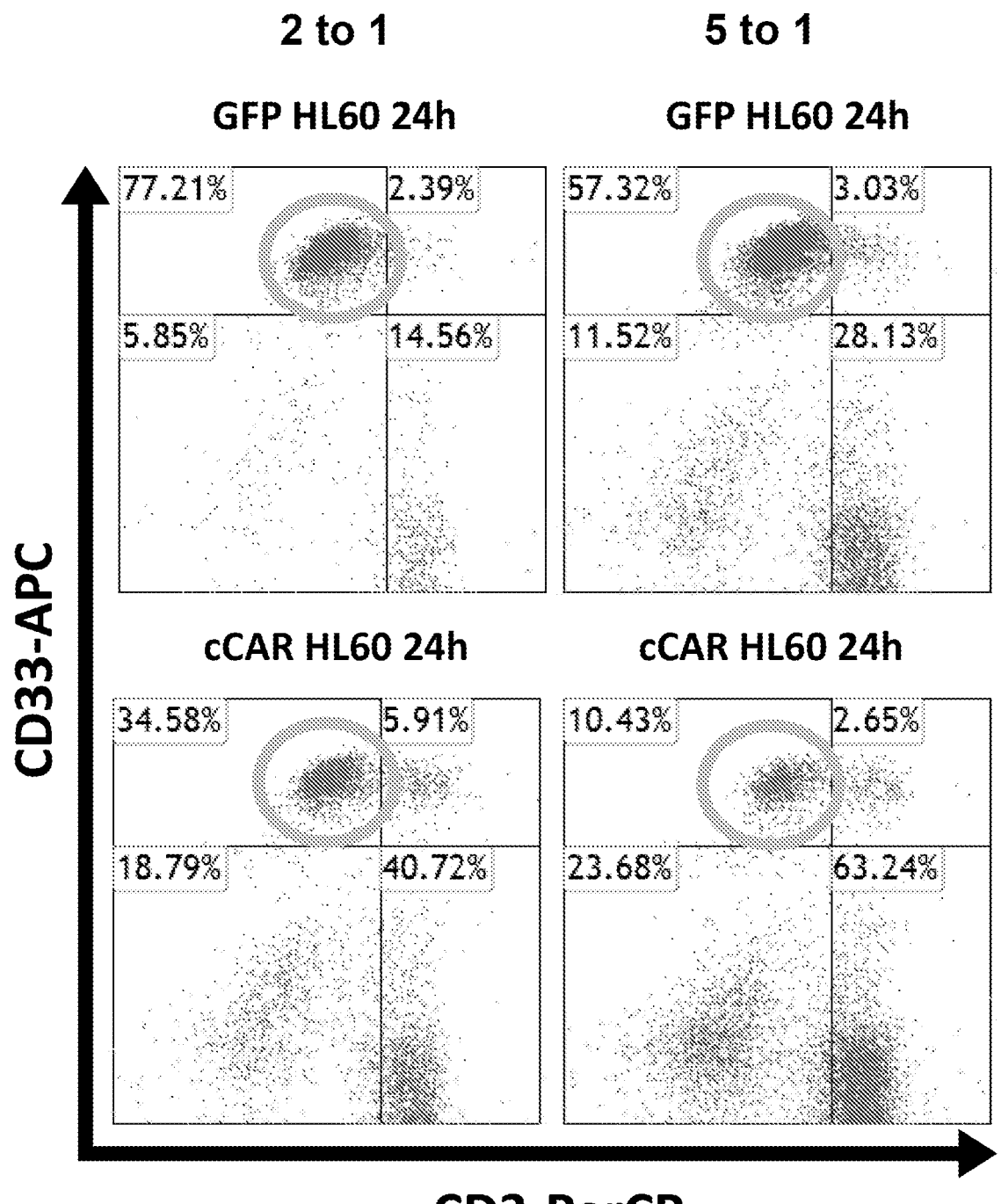

FIG. 4. A co-culture assay representing the incubation of CD33CD123-2G CAR-T cells (cCAR) with the promyelocytic leukemia cell line HL60. cCAR-T cell (lower panel) is compared to control GFP transduced T-cell (upper panel). The efficacy of the killing is measured by the population of CD33+ cells that is left over after incubation for about 24 hours (enclosed in yellow circles).

Figure 5:
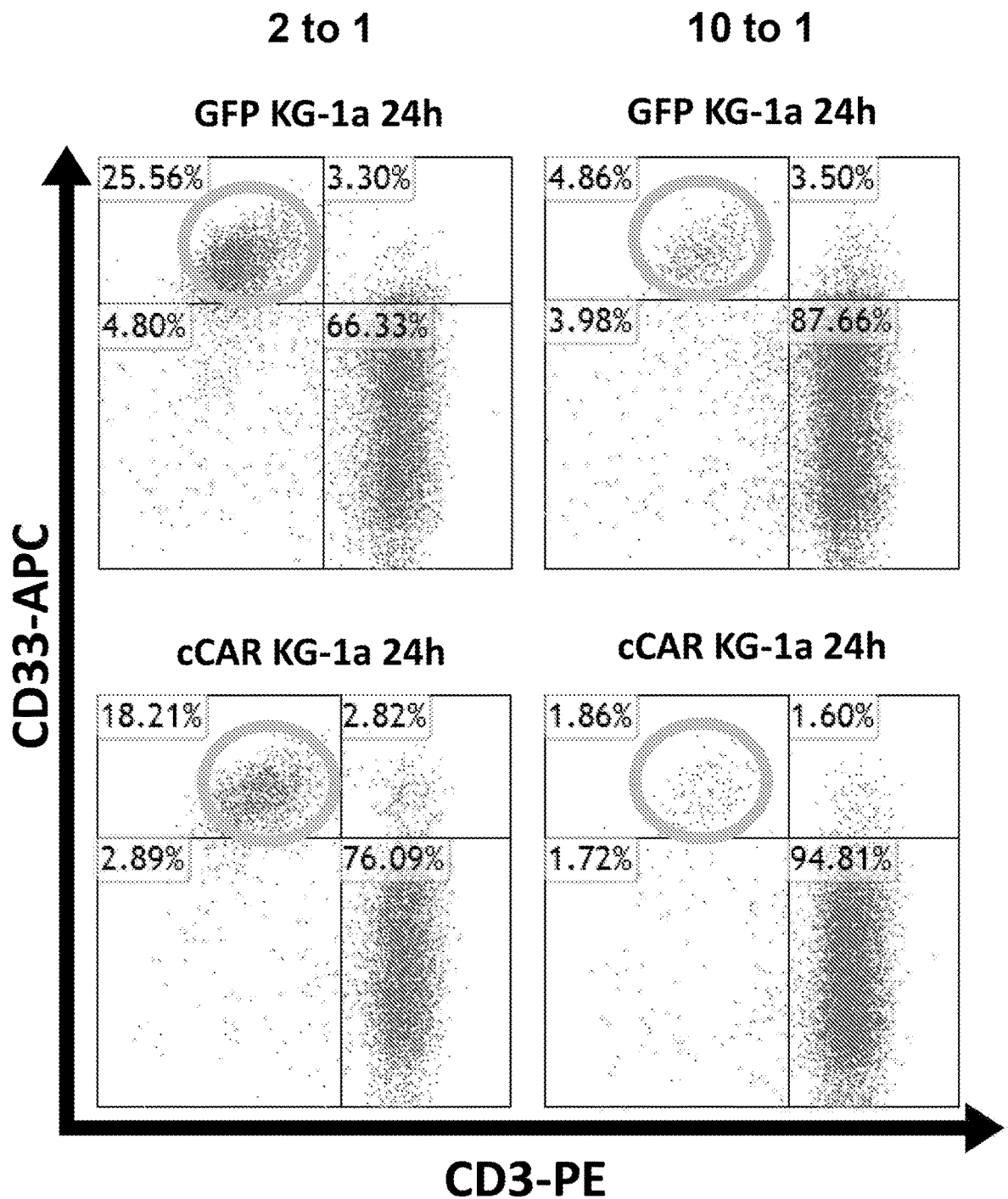

FIG. 5. A co-culture assay representing incubation of cCAR-T cells with the myelogenous leukemia cell line KG-1a, which expresses about 100% CD33 and about 50-80% CD123. cCAR-T cell (lower panel) is compared to control GFP transduced T-cell (upper panel). The efficacy of the killing is measured by the population of CD33+ cells that is left over after incubation for about 24 hours.

Figure 6:
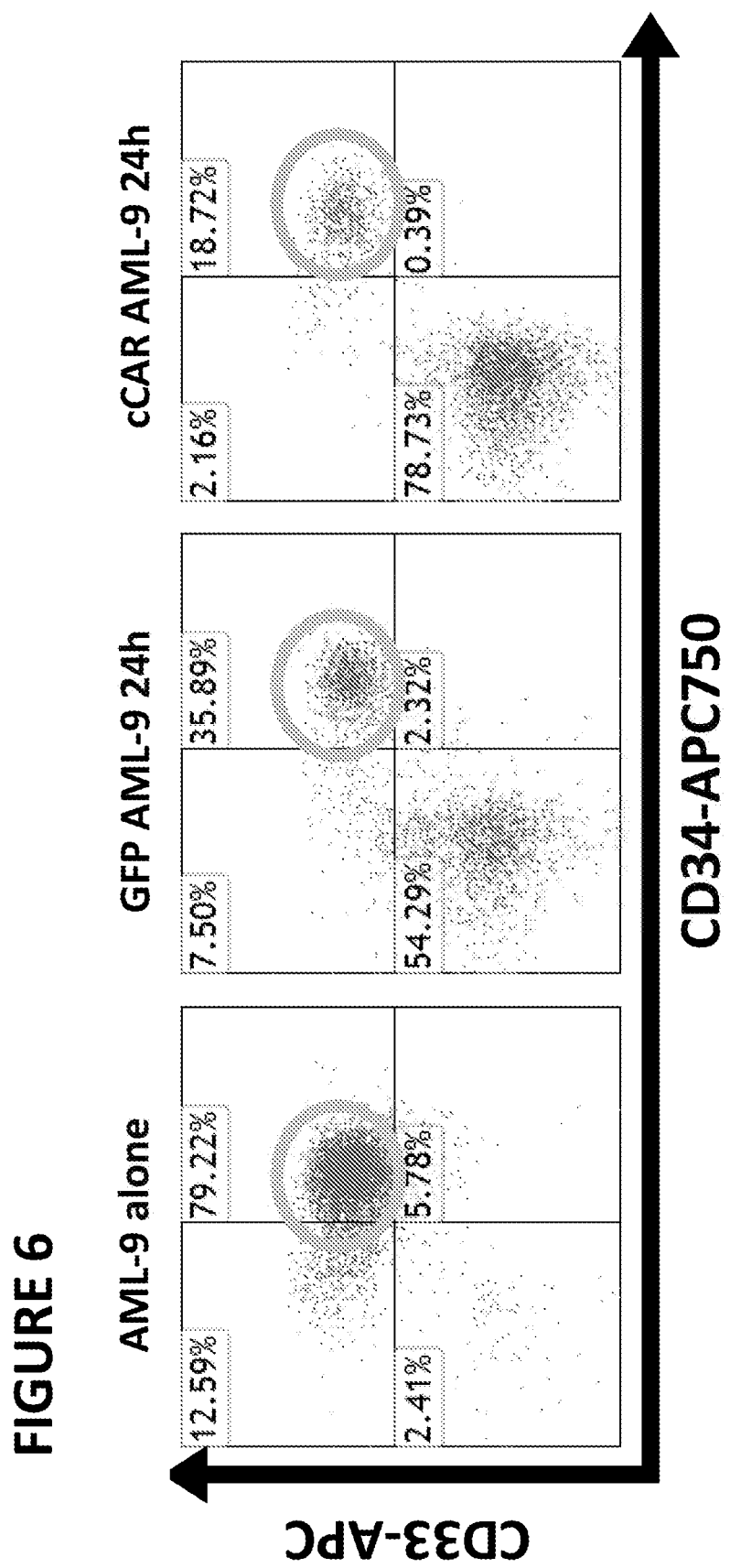

FIG. 6. CD33CD123 cCAR-T cells co-cultures with AML-9 at 5:1. A co-culture assay representing incubation of cCAR-T cells with AML patient samples (here referred to as AML-9). The patient cells include mixed populations of cells, such as for example, leukemia cells, monocytes, and other types of blasts. CD33 acts as a marker for CAR-T action as well as CD34, a specific marker for leukemia cells. The CAR-T panel (right) is compared to control GFP transduced T-cells (middle). The efficacy of the killing is measured by the population of CD33+/CD34+ cells that is left over after incubation for at least 24 hours.

Figure 7:
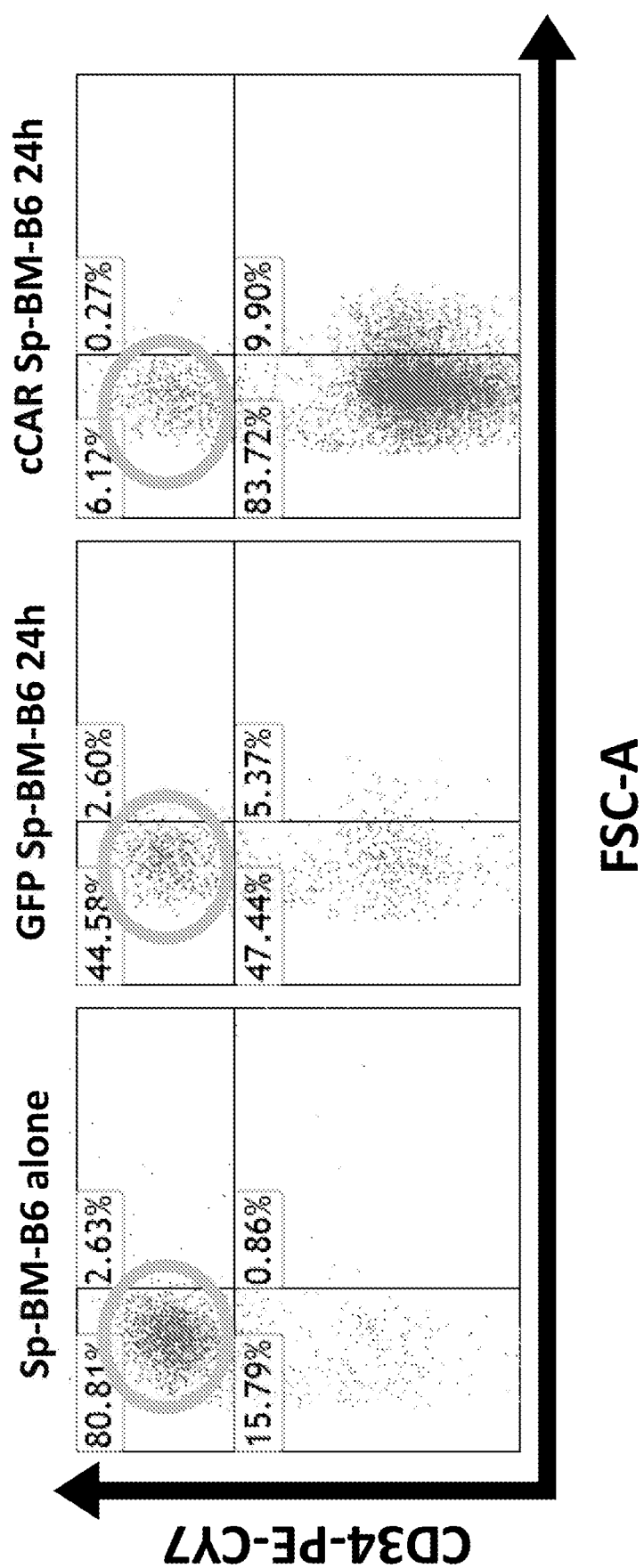

FIG. 7. CD33CD123 cCAR-T cells co-cultures with Sp-BM-B6 at 5:1. A co-culture assay representing incubation of cCAR-T cells with B-ALL patient samples (here referred to as Sp-BM-B6). The patient cells include mixed populations of cells, such as, for example, leukemia cells, monocytes, and other types of blasts. CD34 acts as a specific marker for leukemia cells. The CAR-T panel (right) is compared to control GFP transduced T-cells (middle). The efficacy of the killing is measured by the population of CD34+ cells left over after incubation for at least 24 hours.

Figure 8:
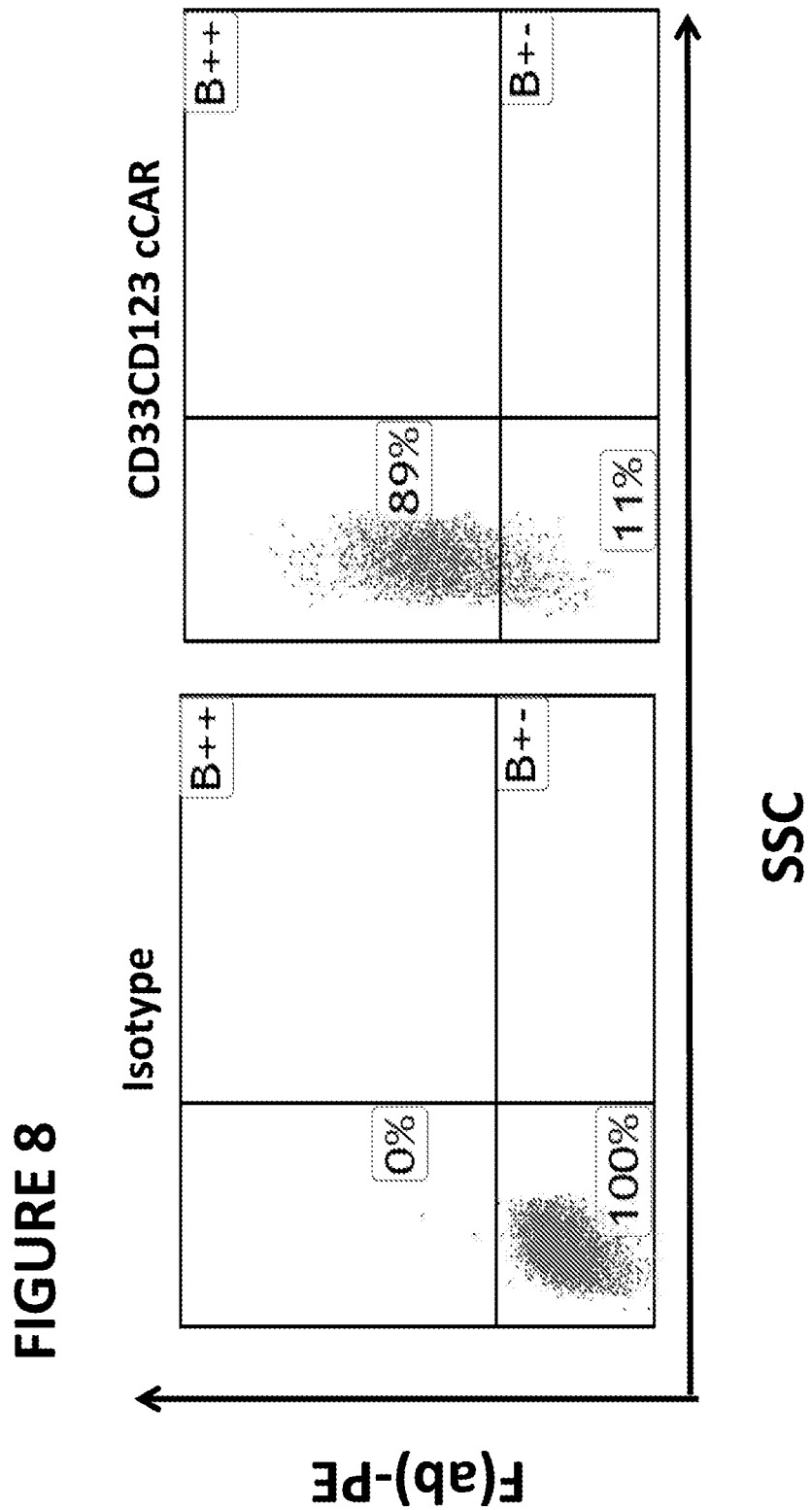

FIG. 8. CD33CD123 cCAR expression in NK-92 cells. The CD33CD123 cCAR expression are detected using goat-anti-mouse antibody, F(ab)2.

FIG. 9. A co-culture assay representing incubation of CD33CD123 cCAR NK-92 cells with HL-60. The cCAR NK-92 cells are compared with GFP transduced NK-92 cells. The efficacy of the killing is measured by the population of CD33+ cells left over after incubation for about 24 hours.

Figure 10:
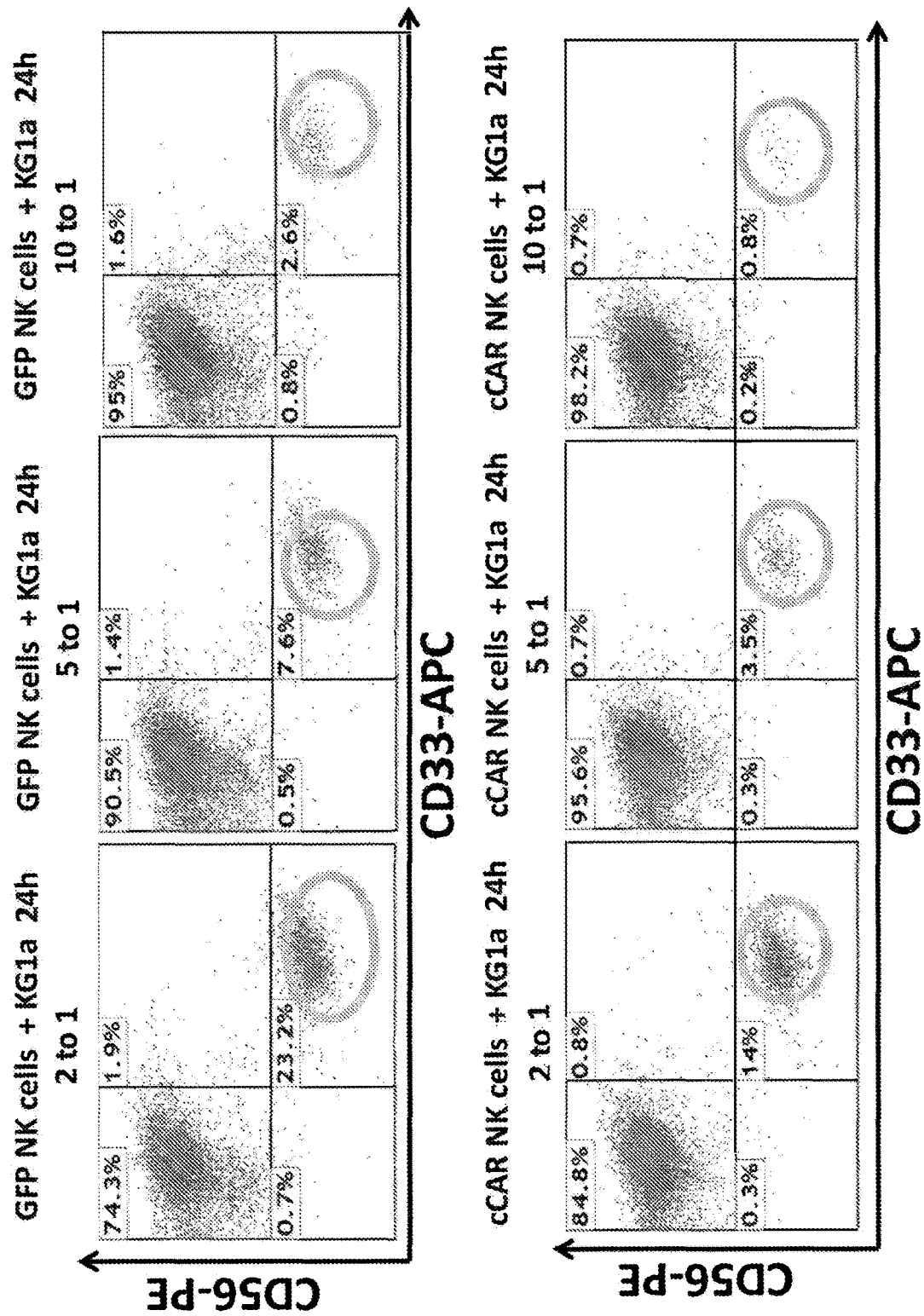

FIG. 10. A co-culture assay representing incubation of cCAR NK-92 cells with KG1a. The cCAR NK cell panel is compared with GFP transduced NK-92 cells. The efficacy of the killing is measured by the population of CD33+ cells left over after incubation for about 24 hours.

Figure 11:
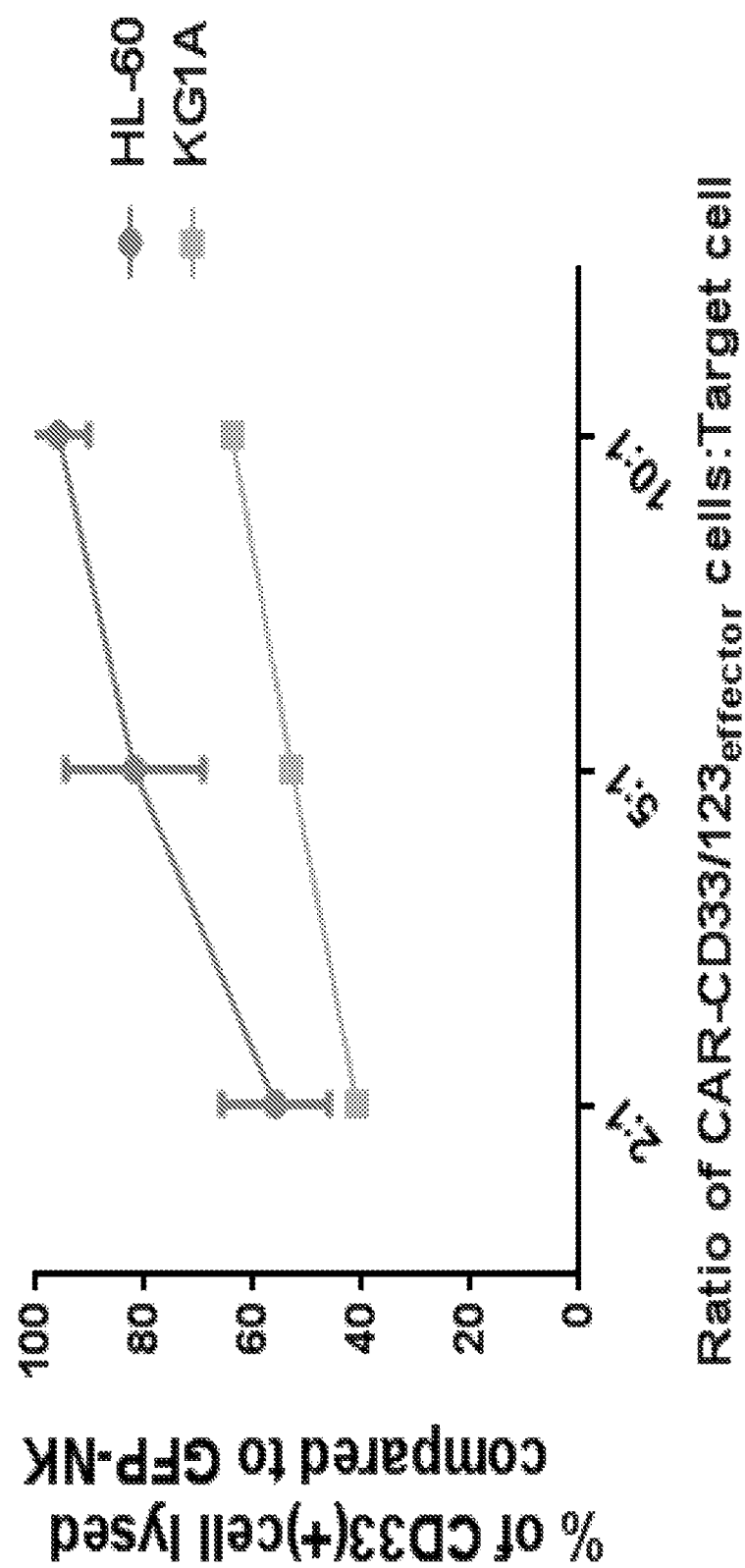

FIG. 11. Dose response of CD33CD123 cCAR (CAR-CD33/123) NK-92 cells with HL-60 or KG1a. The efficacy of the killing is measured by the population of CD33+ cells left over after incubation for about 24 hours.

Figure 12:
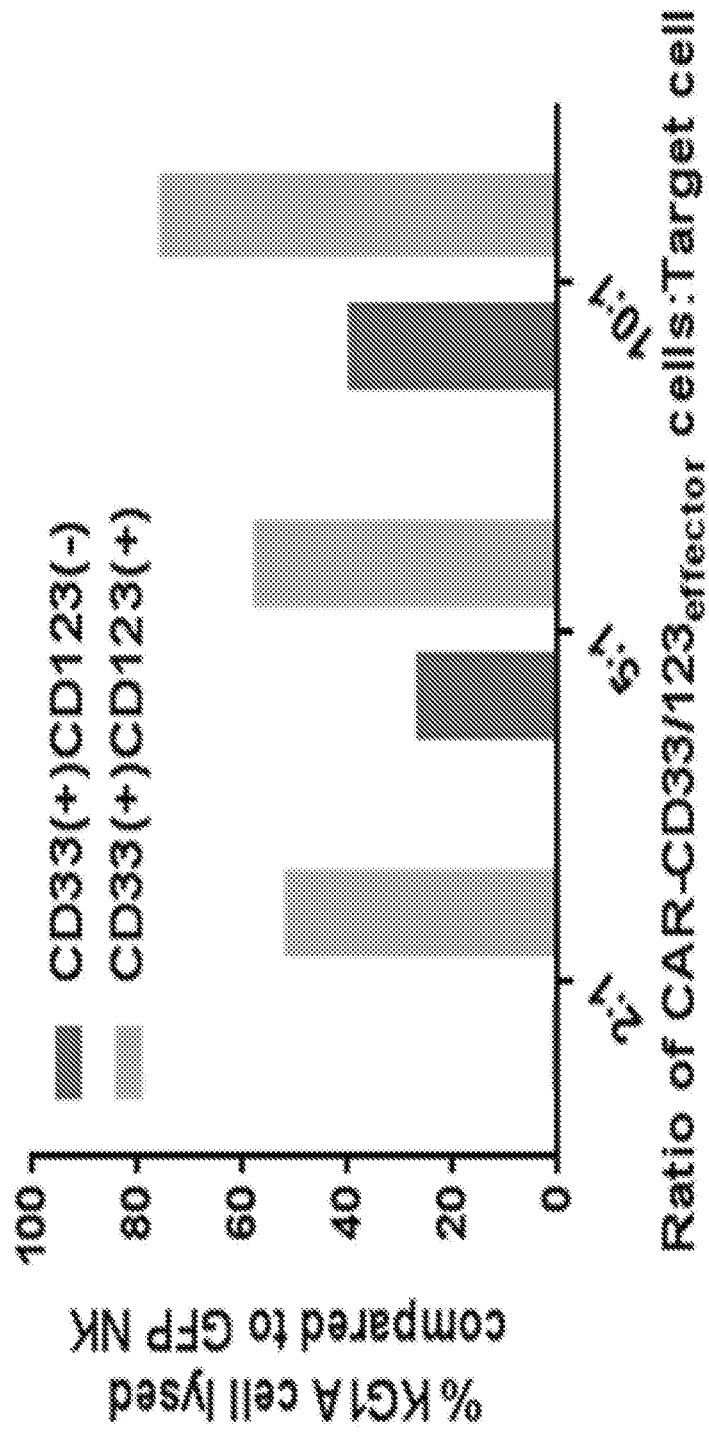

FIG. 12. A comparison of CD33CD123 cCAR NK-92 cell killing ability with control in two populations of KG11 cells. Assays were performed at different ratios of CAR-CD33/123 (CD33CD123 cCAR NK-92 cells) and target cells, kG1a. The efficacy of the killing is measured by the population of CD33+CD123+ or CD33+CD123− cells left over after incubation for about 24 hours.

Figure 13A:
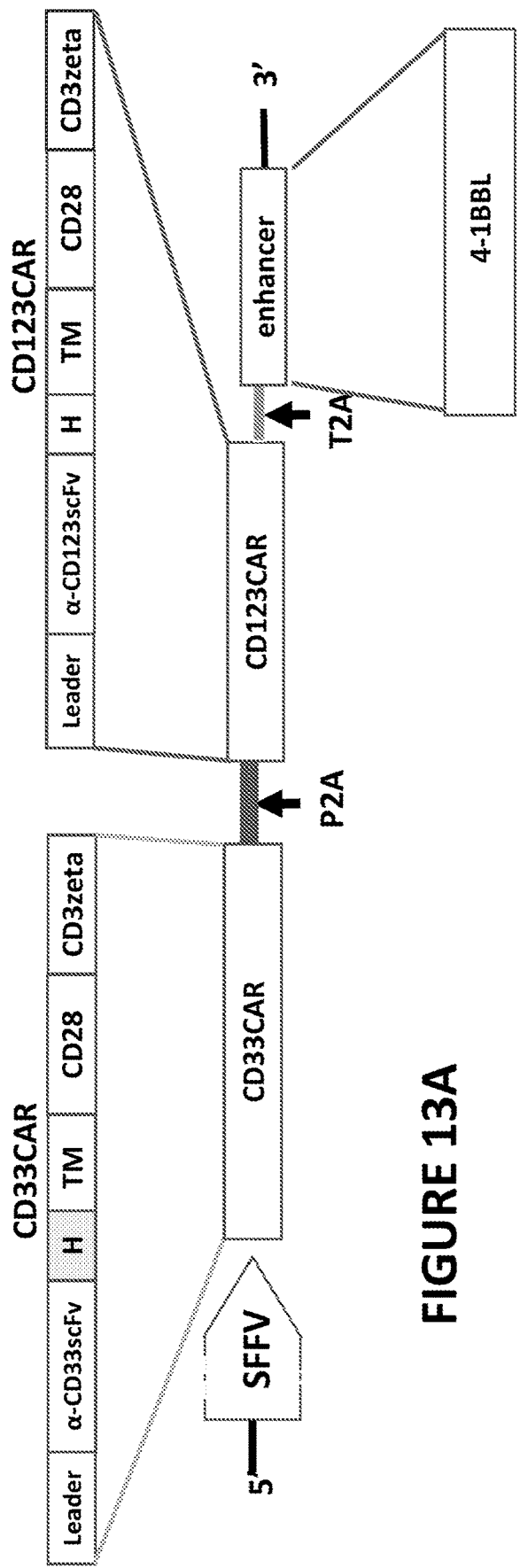

FIG. 13A. Links by P2A and T2A schematic showing both cCAR-T and 4-1BBL in a single construct. The construct consists of a SFFV promoter driving the expression of two modular units of CARs A peptide and an enhancer, 4-1BBL. Upon cleavage of the linkers, the cCARs and 4-1BBL split and engage upon targets expressing CD33 and/or CD123 and 4-1BBL. Compound CAR, CD33CD123 CAR T cells received not only costimulation through the CD28 but also 4-1BB ligand (4-1BBL or CD137L). The CD3-zeta signaling domain completes the assembly of this CAR-T.

Figure 13B:
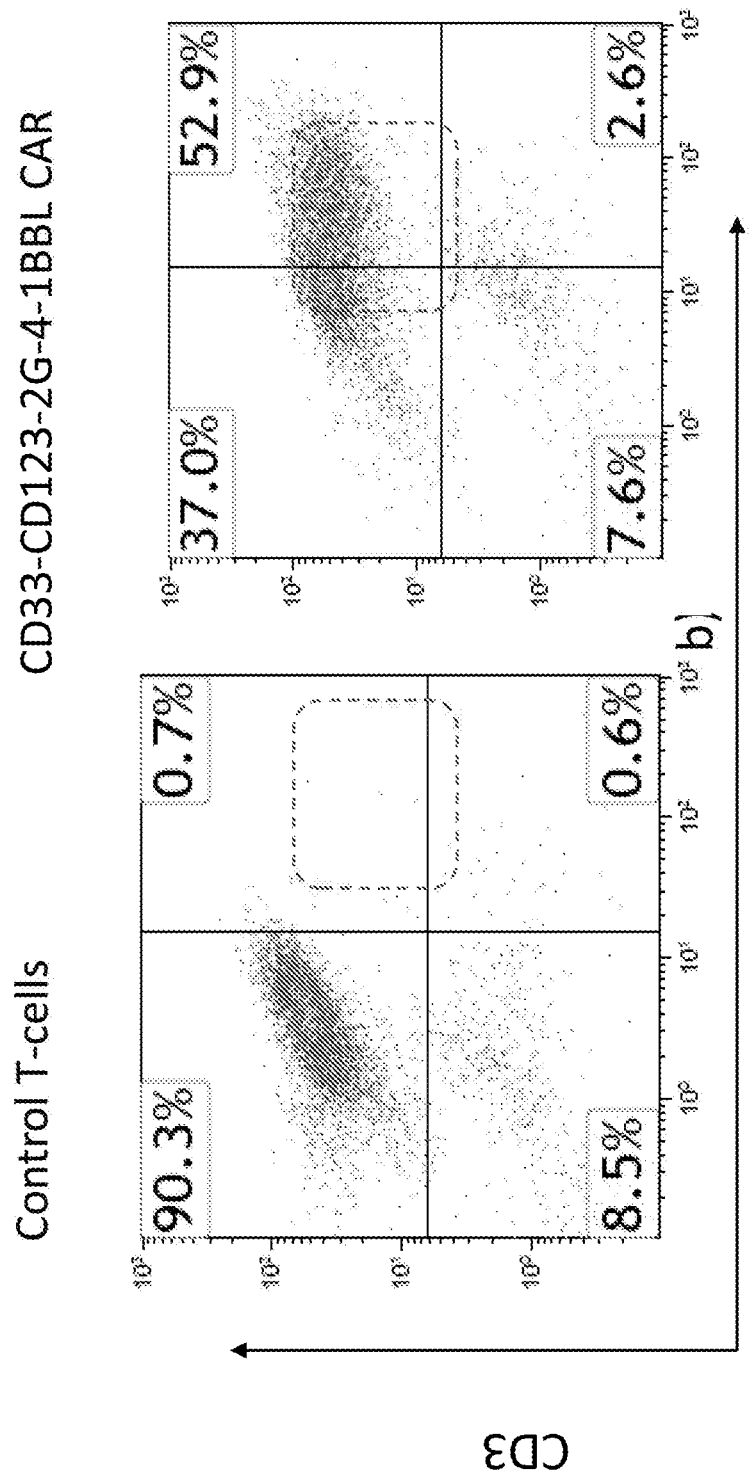

FIG. 13B. Expression the CD33CD123-41BBL-2G construct in T-cells. T-cells derived from peripheral blood from healthy donors were transduced with the CD33CD123-4-1BBL-2G construct in 6-well plates incubated with 2 ml of virus supernatant. CAR expression was assayed with F(ab)' labeling for surface expression of the CAR protein and subsequently underwent FACS analysis. Transduced cells were compared to control T-cells labeled at the same time. Expression was determined and transduced population encircled on plot 1 day after end of transduction period.

Figure 14:
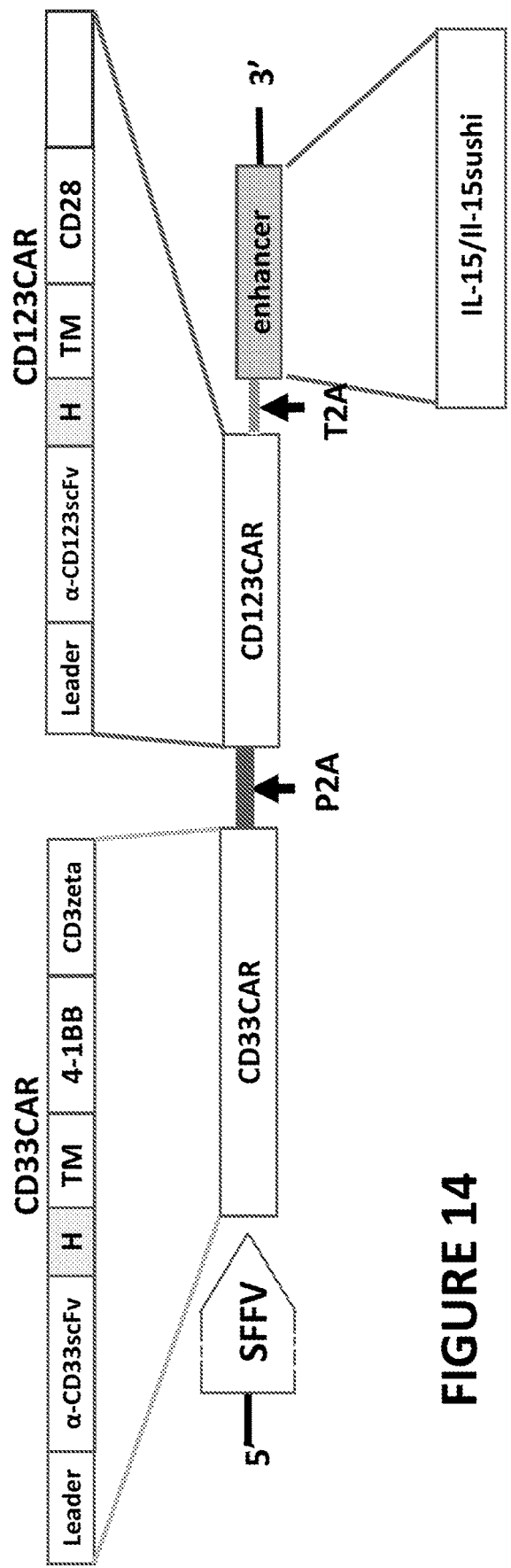

FIG. 14. Links by P2A and T2A schematic showing both cCAR-T and IL-15/IL-15sushi in a single construct. The construct consists of a SFFV promoter driving the expression of two modular units of CARs and an enhancer, IL-15/IL-15sushi. Upon cleavage of the linkers, the cCARs and IL-15/IL-15sushi split and engage upon targets expressing CD33 and/or CD123. The CD3-zeta signaling domain completes the assembly of this CAR-T. The enhancers include, but not limited to, IL-15/IL-15sushi on cCAR.

Figure 15:
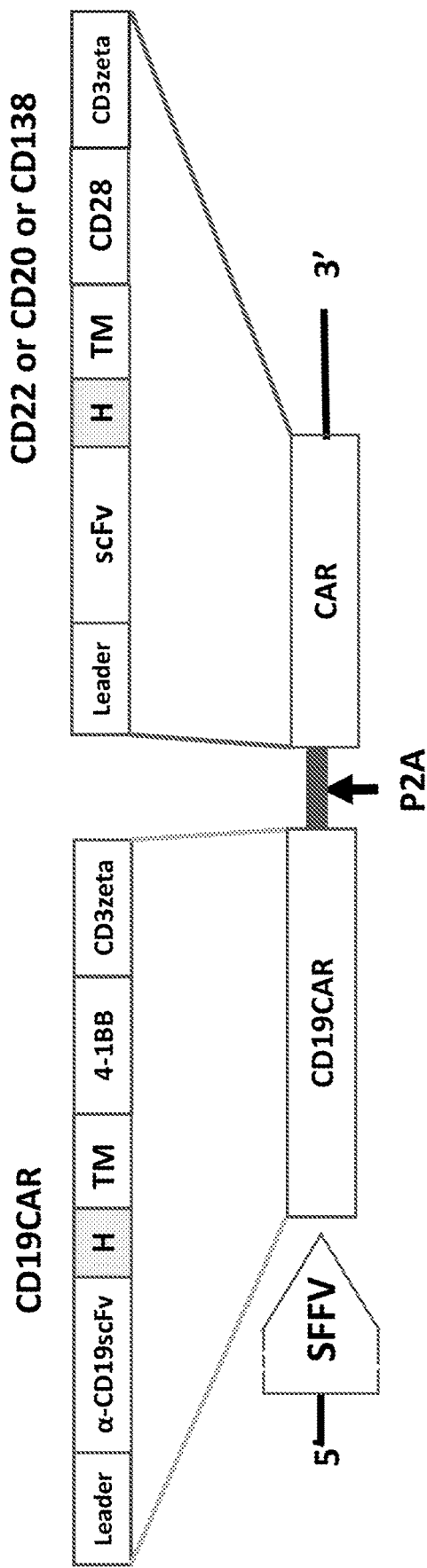

FIG. 15. A schematic representation of cCAR. The construct comprises a SFFV promoter driving the expression of multiple modular units of CARs linked by a linker. Upon cleavage of the linker, the cCARs split and engage upon targets expressing combinations of various target antigens: CD19 and/or CD20, and/or CD22 and/or 138. Multiple cCARs utilize the same or different co-stimulatory domains, such as, without limiting 4-1BB (also labeled as 4-BB) and/or CD28.

FIG. 16. Activated T cells transduced to make CD19CD20-2G, CD19CD22-2G CAR T cells (all are L8). (16A) Design of compound CARs. (16B) Western blot. HEK-293T cells were transfected with lentiviral plasmids for control vector (lane 1), CD19CD20-2G (lane 2), and CD19CD22-2G (lane 3). 48 hours after transfection, supernatant was removed, and cells were also harvested. Cells were lysed for Western blot and probed with mouse anti-human CD3z primary antibody, and goat anti-mouse HRP secondary antibody. (16C) PMBC buffy coat T cells were activated 3 days with anti-CD3 antibody. Cells were transduced with either control vector (left), CD19CD20-2G (middle), or CD19CD22-2G, (right) lentiviral supernatant. After 3 days of incubation, cells were harvested and incubated with goat anti-mouse Fab2 or goat IgG antibodies conjugated with biotin for 30 minutes. Cells were washed, suspended and stained with streptavidin-PE and mouse anti-human CD3-PerCp for 30 minutes. Cells were washed and suspended in 2% formalin, and analyzed by flow cytometry to determine CAR efficiency. (N=2).

Figure 17:
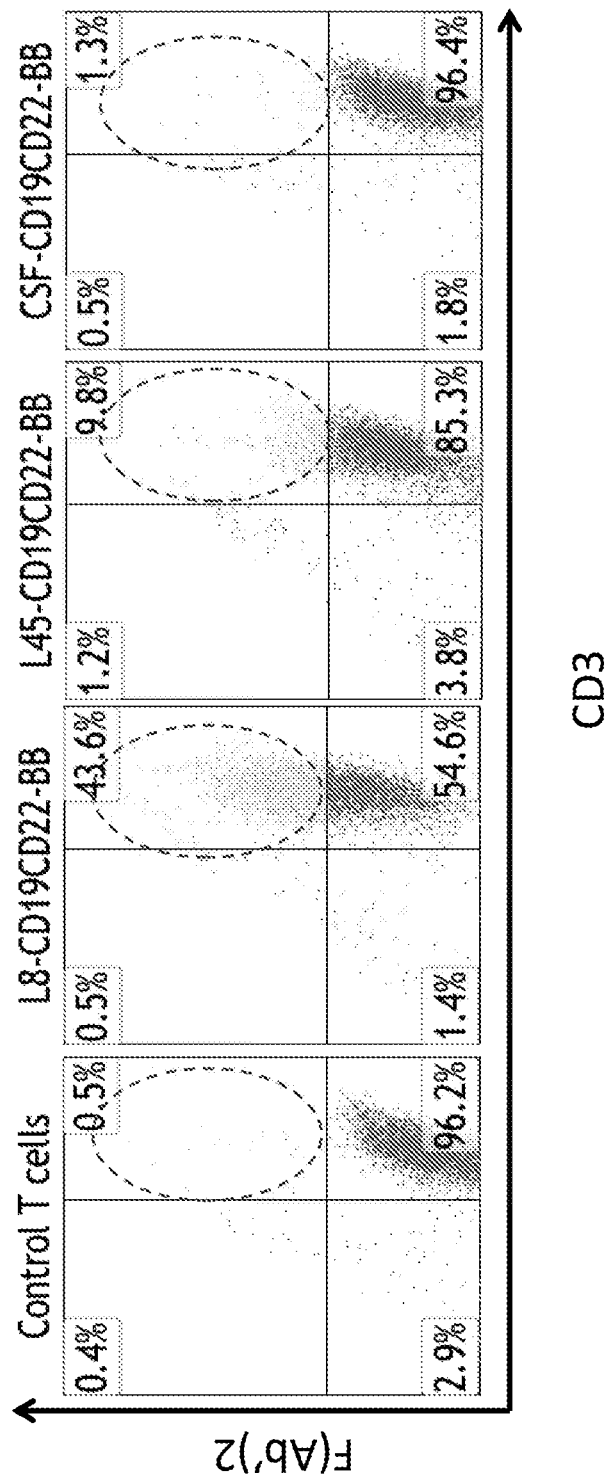

FIG. 17. Expression of compound CD19CD22CAR T cells using different leader sequences. PMBC buffy coat T cells were activated 3 days with anti-CD3 antibody. Cells were transduced with either control vector (left), L8-CD19CD22-2GCAR (middle left), L45-CD19CD22-2GCAR, (middle right) or CSF-CD19CD22-2GCAR (right) lentiviral supernatant. The supernatants were each 3× concentrated. After 3 days of incubation, cells were harvested and incubated with goat anti-mouse Fab2 or goat IgG antibodies conjugated with biotin for 30 minutes. Cells were washed, suspended and stained with streptavidin-PE and mouse anti-human CD3-PerCp for 30 minutes. Cells were washed and suspended in 2% formalin, and analyzed by flow cytometry to determine CAR efficiency. (N=2).

Figure 18:
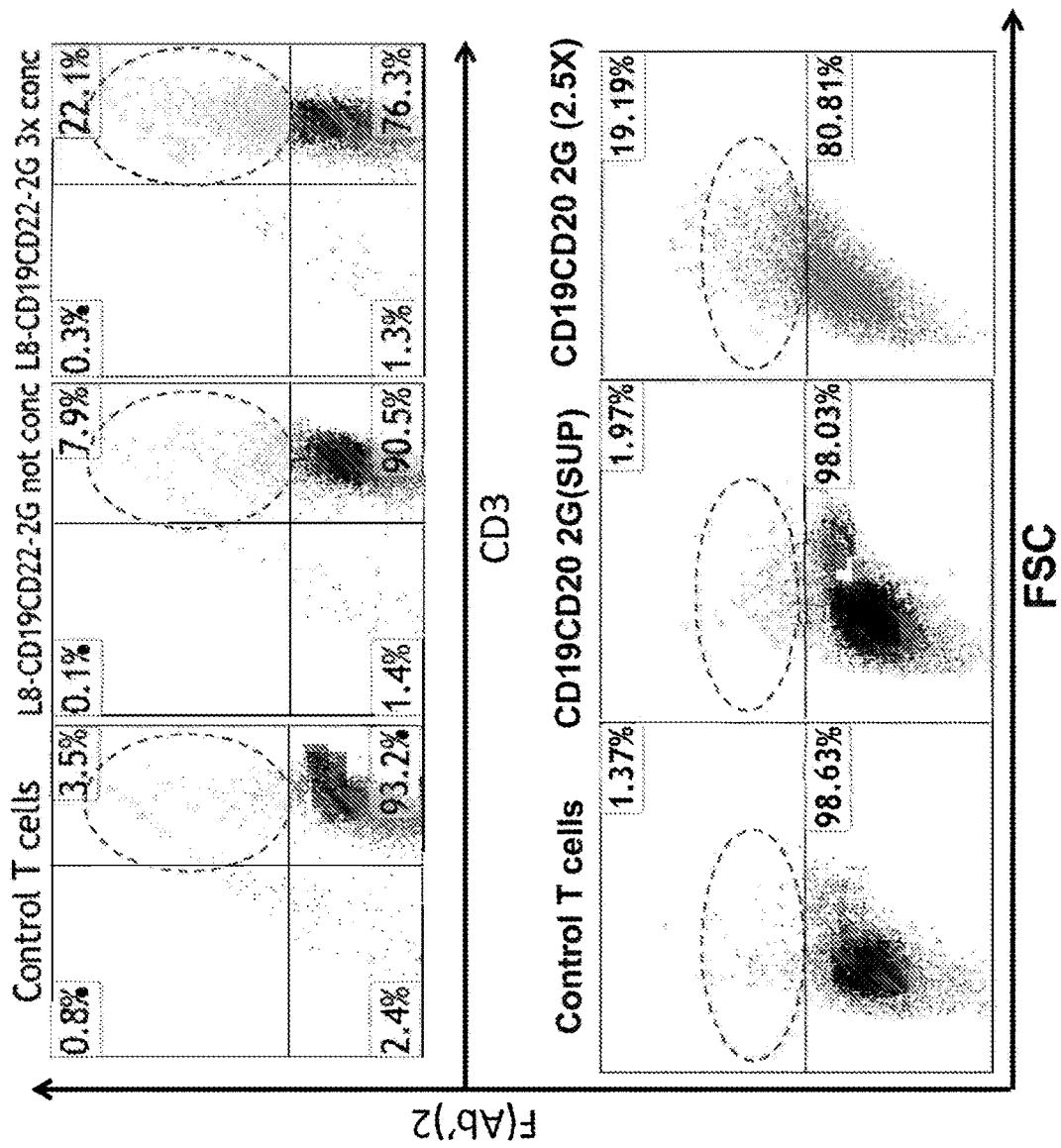

FIG. 18. Comparison of transduction efficiency using concentrated vs. unconcentrated L8-CD19CD22-2G or L8-CD19CD20-2G lentiviral supernatant. A. PMBC buffy coat T cells were activated 3 days with anti-CD3 antibody. Cells were transduced with either control vector (left), unconcentrated (middle) L8-CD19CD22-2GCAR or 3× concentrated L8-CD19CD22-2GCAR (right) lentiviral supernatant. After 3 days of incubation, cells were harvested and incubated with goat anti-mouse Fab2 or goat IgG antibodies conjugated with biotin for 30 minutes. Cells were washed, suspended and stained with streptavidin-PE and mouse anti-human CD3-PerCp for 30 minutes. Cells were washed and suspended in 2% formalin, and analyzed by flow cytometry to determine CAR efficiency. (N=2). B. The same experiment was used for constructs containing L8-CD19CD20-2G unconcentrated or 2.5× concentrated lentiviral vector.

Figure 19:
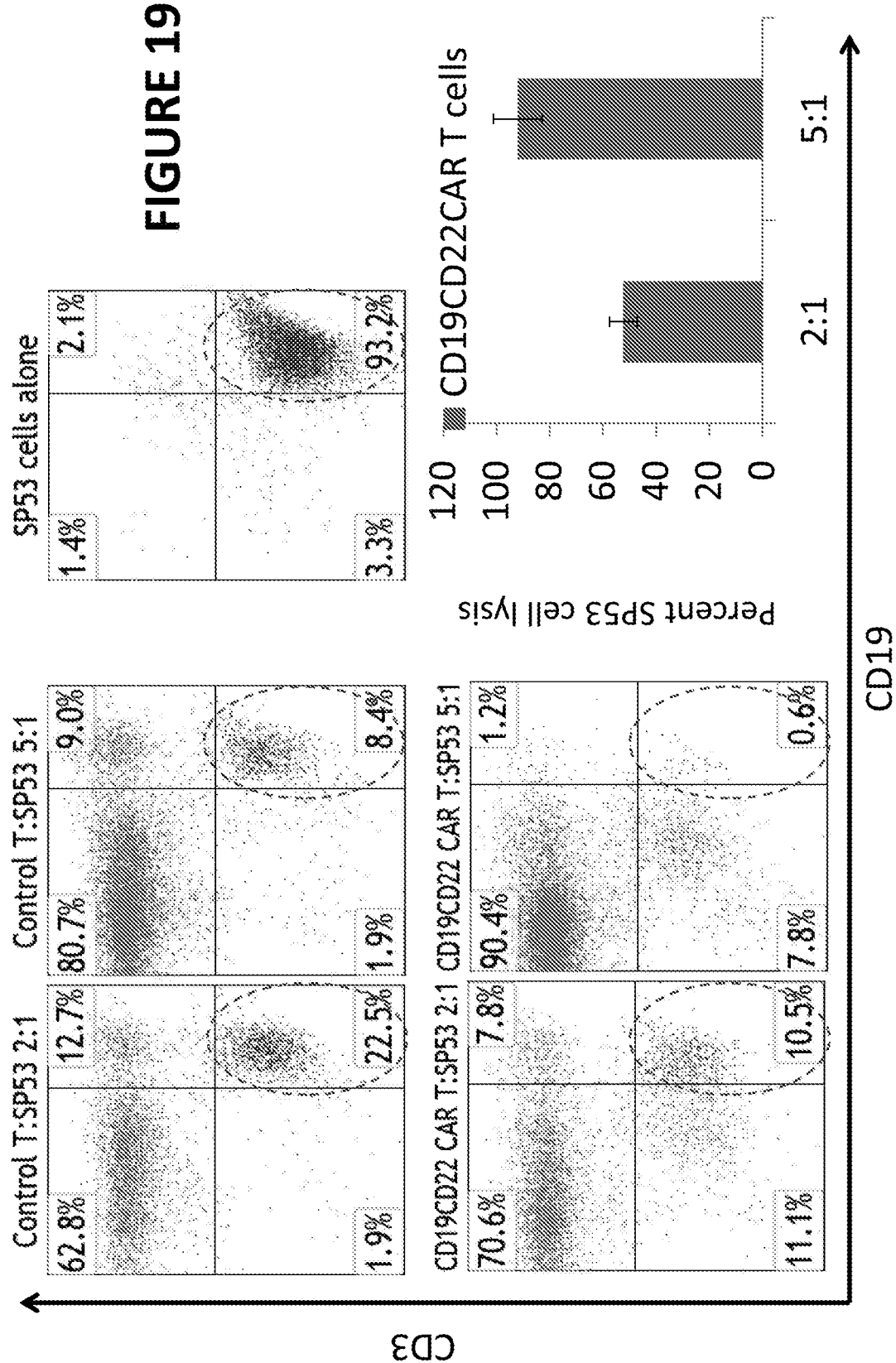

FIG. 19. L8-CD19CD22-2G CAR T cells lyse SP53 tumor cells in overnight co-culture. Activated PMBC T cells transduced with either control (top row), L8-CD19CD22-2G, or (bottom row) lentiviral supernatant were incubated with SP53 cells at the ratios of 1:1 (left) 2:1 (middle) and 5:1 (right), effector:target cells. After 24 hours of incubation at 37° C., samples were washed and stained with anti-human CD3-PerCp and anti-human CD19-APC, washed, and analyzed by flow cytometry. SP53 cells alone are shown on the far upper right, and a summary of percent lysis at each ratio is on the lower right. (N=2).

Figure 20:
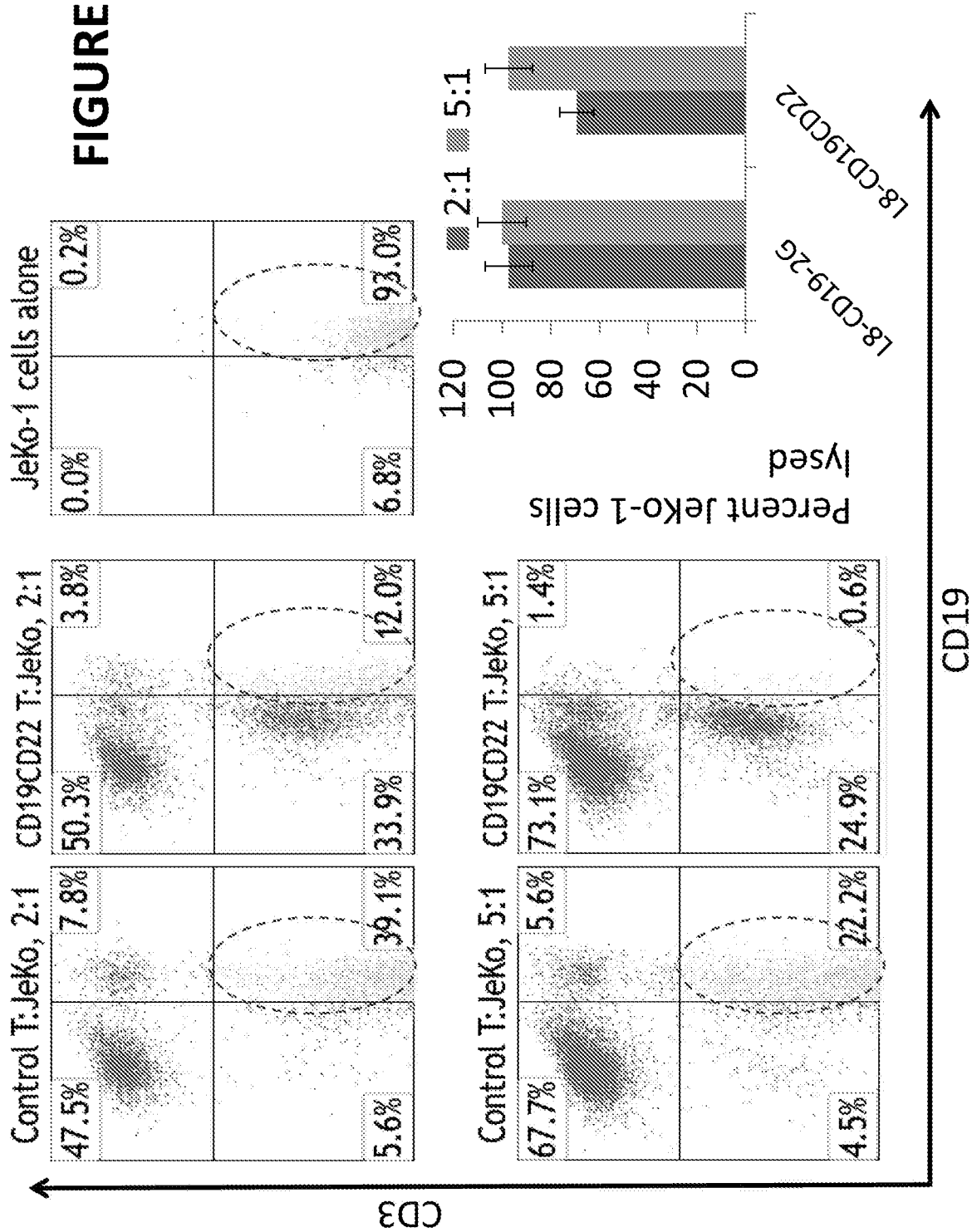

FIG. 20. L8-CD19CD22-2G CAR T cells lyse JeKo-1 tumor cells in overnight co-culture. Activated PMBC T cells transduced with either control (left), or L8-CD19CD22-2G, (middle) 3× concentrated lentiviral supernatant were incubated with JeKo-1 cells at the ratios of 2:1 (top) and 5:1 (bottom), effector:target cells. After 24 hours of incubation at 37° C., samples were washed and stained with anti-human CD3-PerCp and anti-human CD19-APC, washed, and analyzed by flow cytometry. JeKo-1 cells alone and a summary of cell lysis are shown on the right. (N=2).

Figure 21:
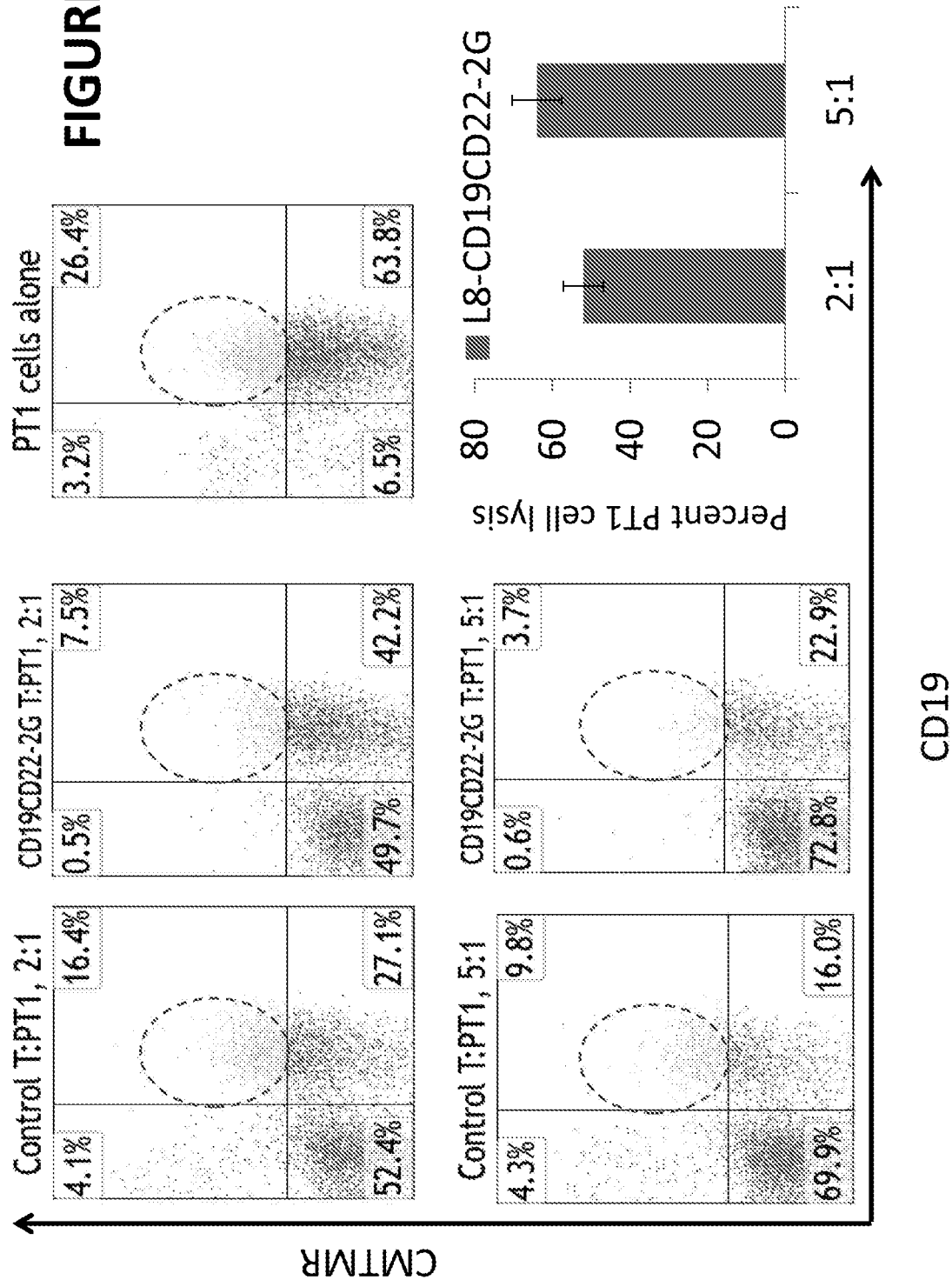

FIG. 21. L8-CD19CD22-2G CAR T cells lyse AML patient cells in overnight co-culture. Activated PMBC T cells transduced with either control (left), or L8-CD19CD22-2G, (middle) 3× concentrated lentiviral supernatant were incubated with CMTMR-stained cells from a patient diagnosed with AML (PT1) at the ratios of 2:1 (top) and 5:1 (bottom), effector:target cells. After 24 hours of incubation at 37° C., samples were washed and stained with anti-human CD3-PerCp and anti-human CD19-APC, washed, and analyzed by flow cytometry. Patient cells alone and a summary of cell lysis are shown on the right. (N=2).

Figure 22A:
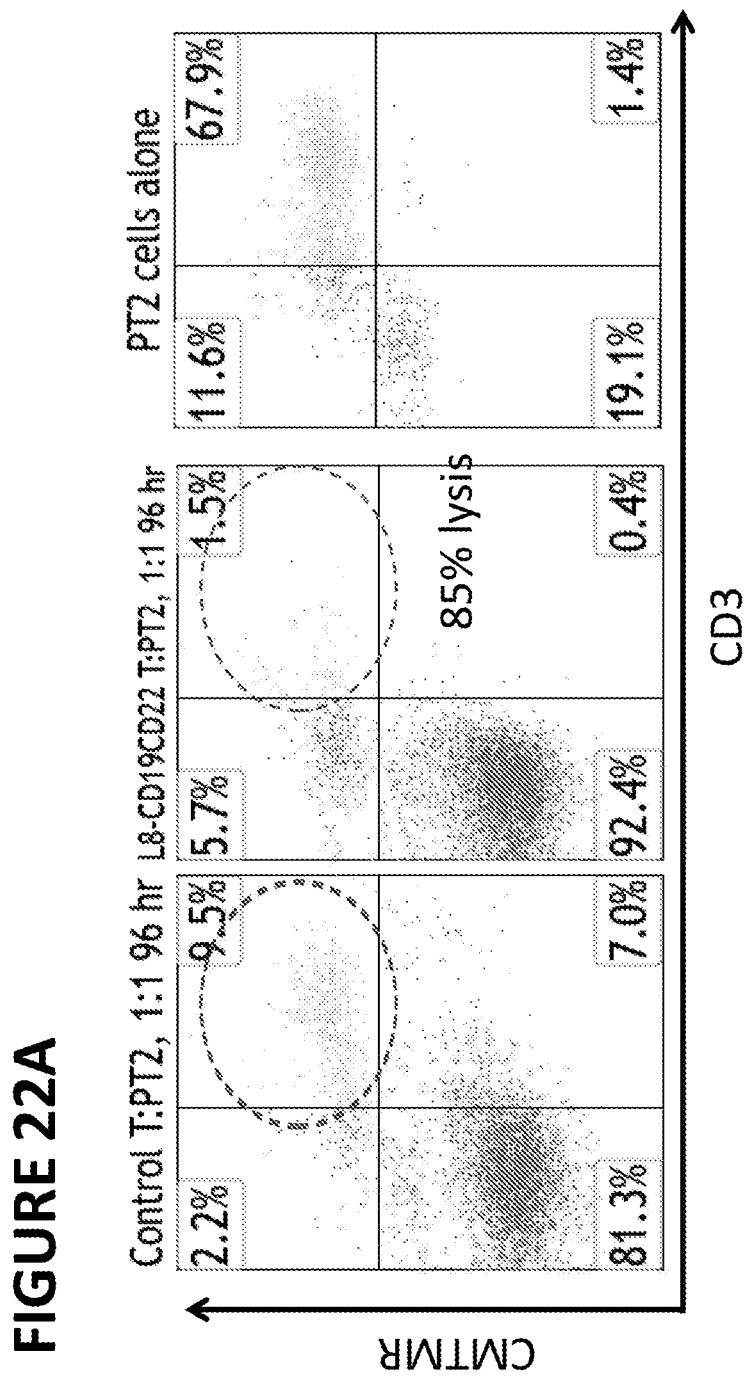

FIG. 22A. L8-CD19CD22-2G CAR T cells deplete CD19+B-ALL patient cells. Activated PMBC T cells transduced with either control (left), or L8-CD19CD22-2G, (middle) lentiviral supernatant were incubated with CMTMR-stained cells from a patient with B-ALL (PT2) at a 1:1 ratio for 4 days in the presence of 2.5% FBS and IL-2. Following this incubation at 37° C., samples were washed and stained with anti-human CD3-PerCp and anti-human CD19-APC, washed, and analyzed by flow cytometry. Prestained patient cells cultured alone for 4 days are shown on the right.

Figure 22B:
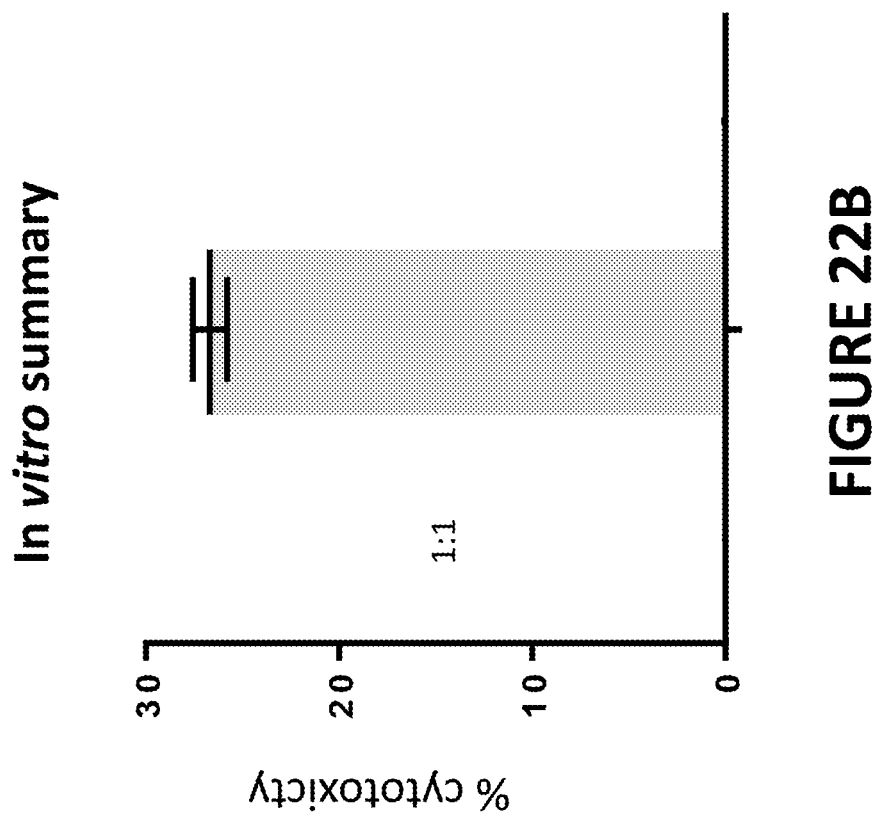

FIG. 22B. L-8-CD19CD22-2G cCAR T-cells show effect on CD22+ K562 cells. An artificial K562 expressing CD22 cell line (K562×p22) via transduction into wild-type K562 cells was generated. Subsequently, we tested the anti-tumor properties of the CD19CD22 cCAR to target the minor CD22+ population of the K562 cells. A co-culture experiment at 1:1 ratio (effective:target) show a modest significant cytotoxic effect on K562 expressing CD22 population compared to the control. Co-cultures were stained with CD3, CD19 and CD22 to separate effector and target populations by flow cytometry. The result was graphed. Cytotoxicity results remain consistent with other numbers reported for anti-tumor activity against artificial antigen presenting cell lines.

Figure 23:
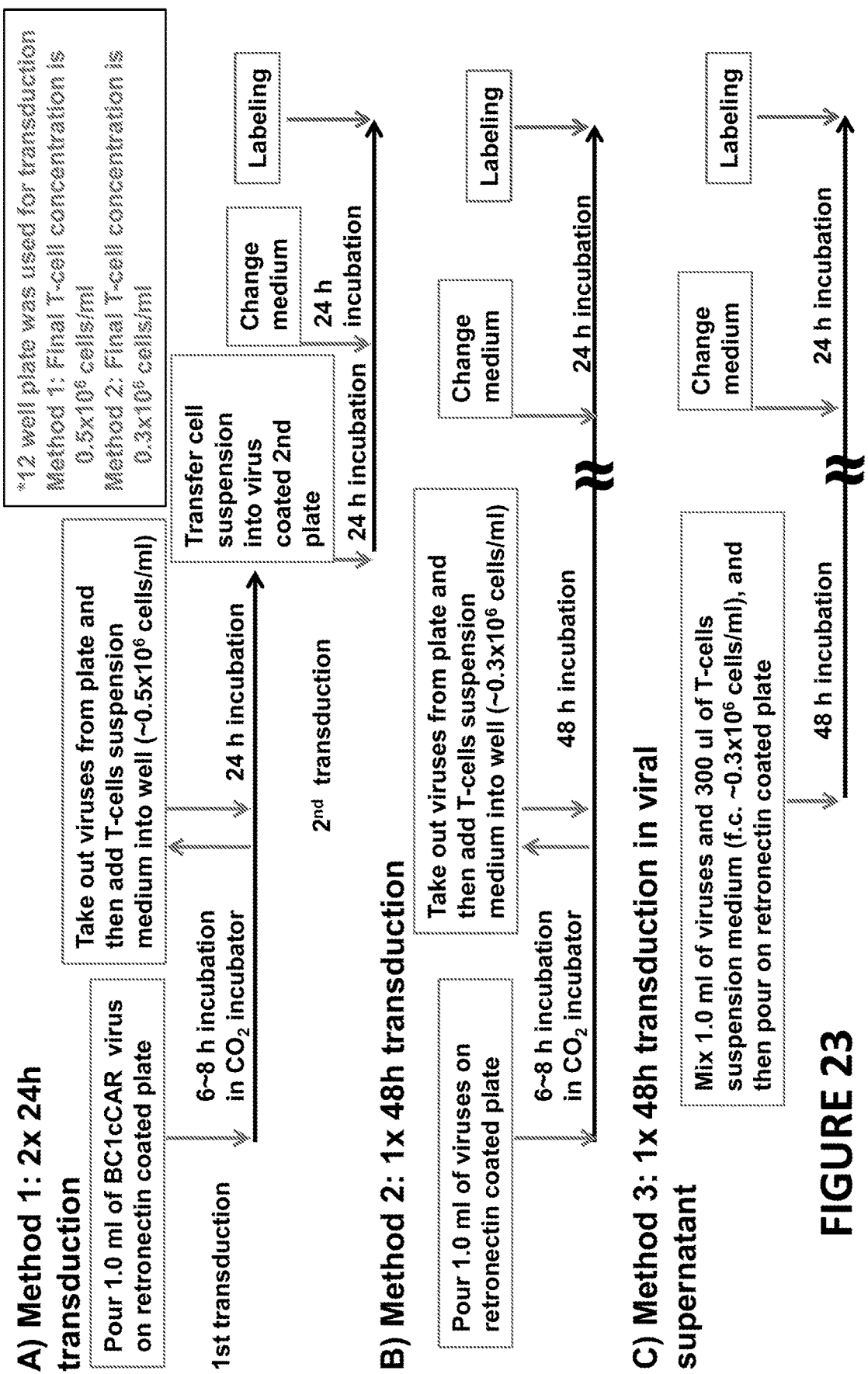

FIG. 23. Various transduction schemes for BC1cCAR lentivirus. (A) Method 1 consisting of a 2× transduction for 24 hours each time is a baseline transduction scheme. Scheme proceeds according to the figure. (B) Method 2 possesses the same methodology as Method 1, however, the second transduction is replaced by continued incubation. (C) Method 2 revised uses viral supernatant incubated with cells directly for 48 hours.

Figure 24A:
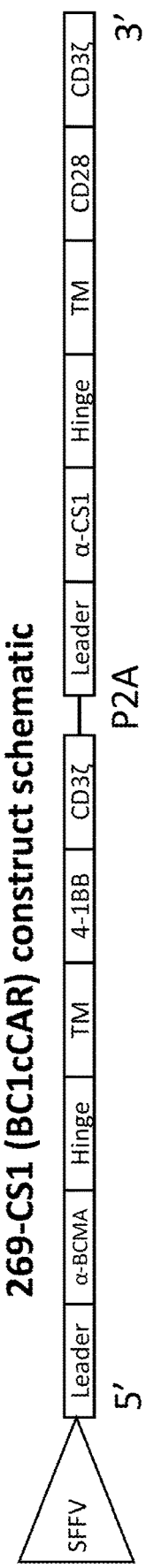
Figure 24B:
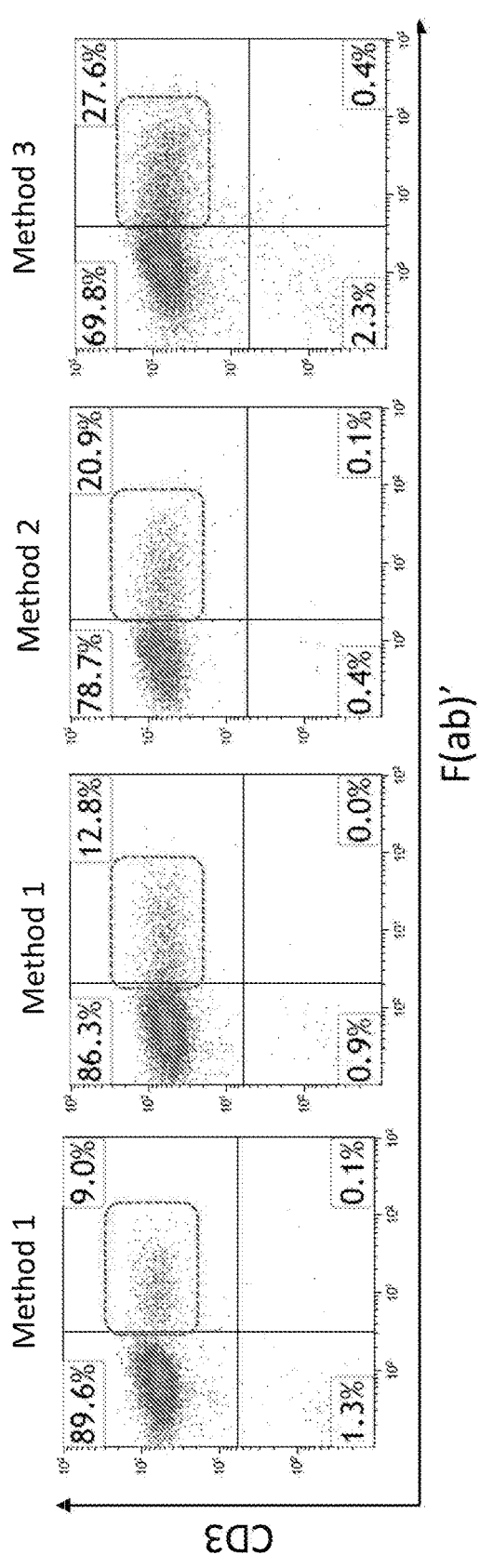
Figures 24C, 24D:
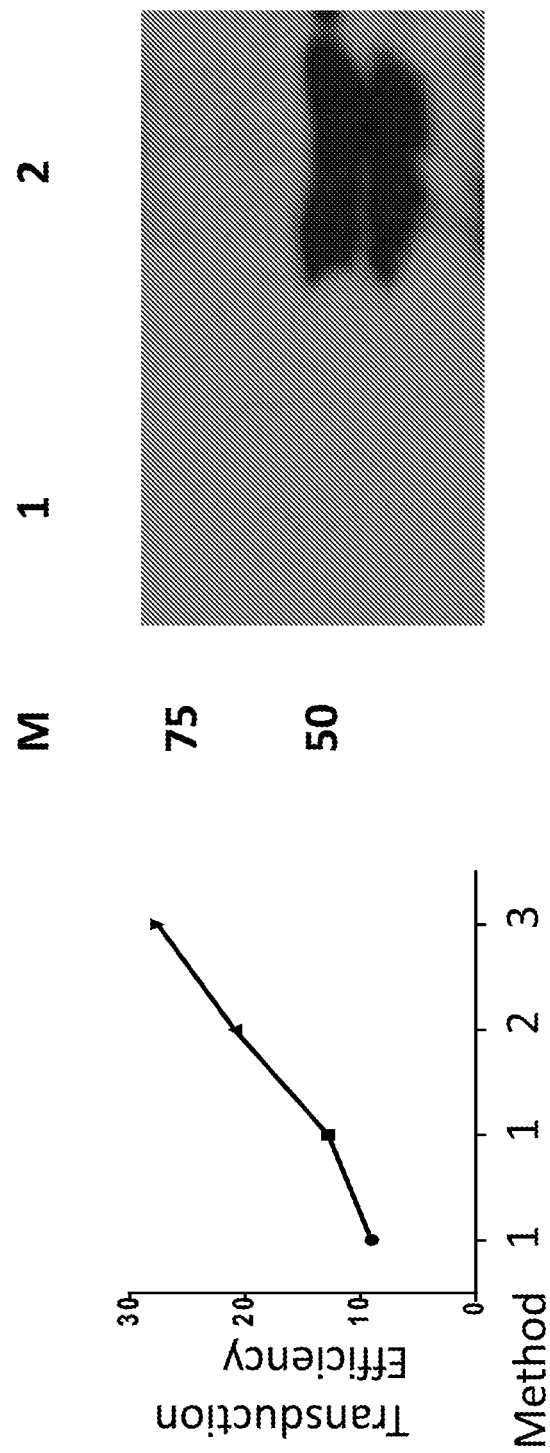

FIGS. 24A-24C: CAR construct scheme and comparison of transduction methodologies. (24A) BC1cCAR's modular design consists of an anti-CD269 (BCMA) single-chain variable fragment (scFv) region fused to an anti-CD319 (CS1) scFv by a self-cleaving P2A peptide, CD8-derived hinge (H) and transmembrane (TM) regions, and tandem CD28 and 4-1BB co-activation domains linked to the CD3ζ signaling domain. A strong spleen focus forming virus promoter (SFFV) and a CD8 leader sequence were used for efficient expression of the CD3CAR molecule on the T-cell surface. (24B) BC1cCAR's expression was measured via flow cytometry against an isotype control. Population encircled represents transduced CAR cells. (24C) Transduction efficiency is improved by optimal methods.

FIG. 24D. Protein expression of BC1cCAR and BCMA-CS1-2G in HEK-293FT cells. HEK-293FT cells were transfected with lentiviral plasmids for GFP (lane 1), BC1cCAR (lane 2) 48 hours after transfection, supernatant was removed, and cells were also removed. Cells were lysed for Western blot and probe with mouse anti-human CD3z antibody. C. Transduction efficiency is improved by optimal methods.

Figure 25A:
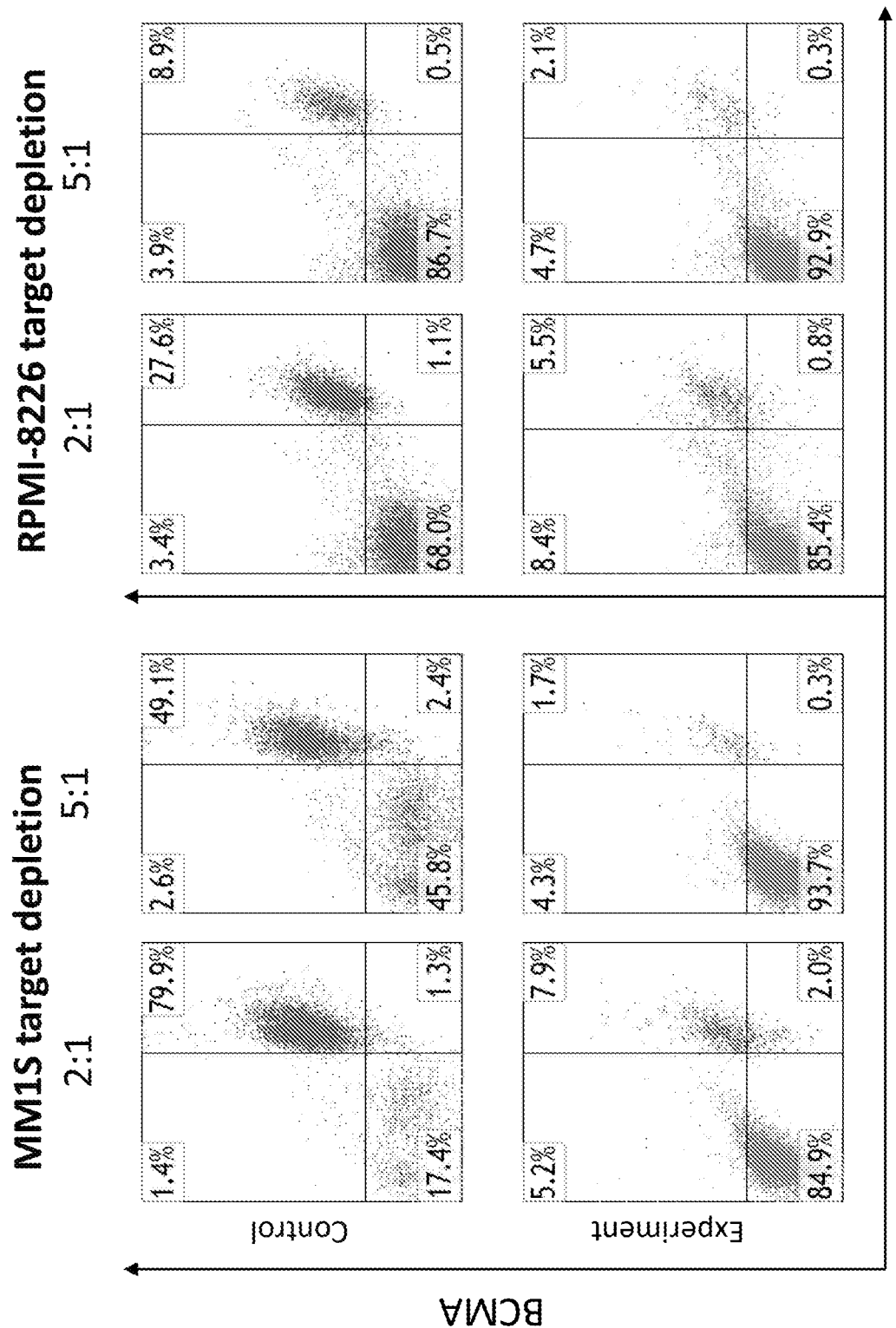
Figure 25B:
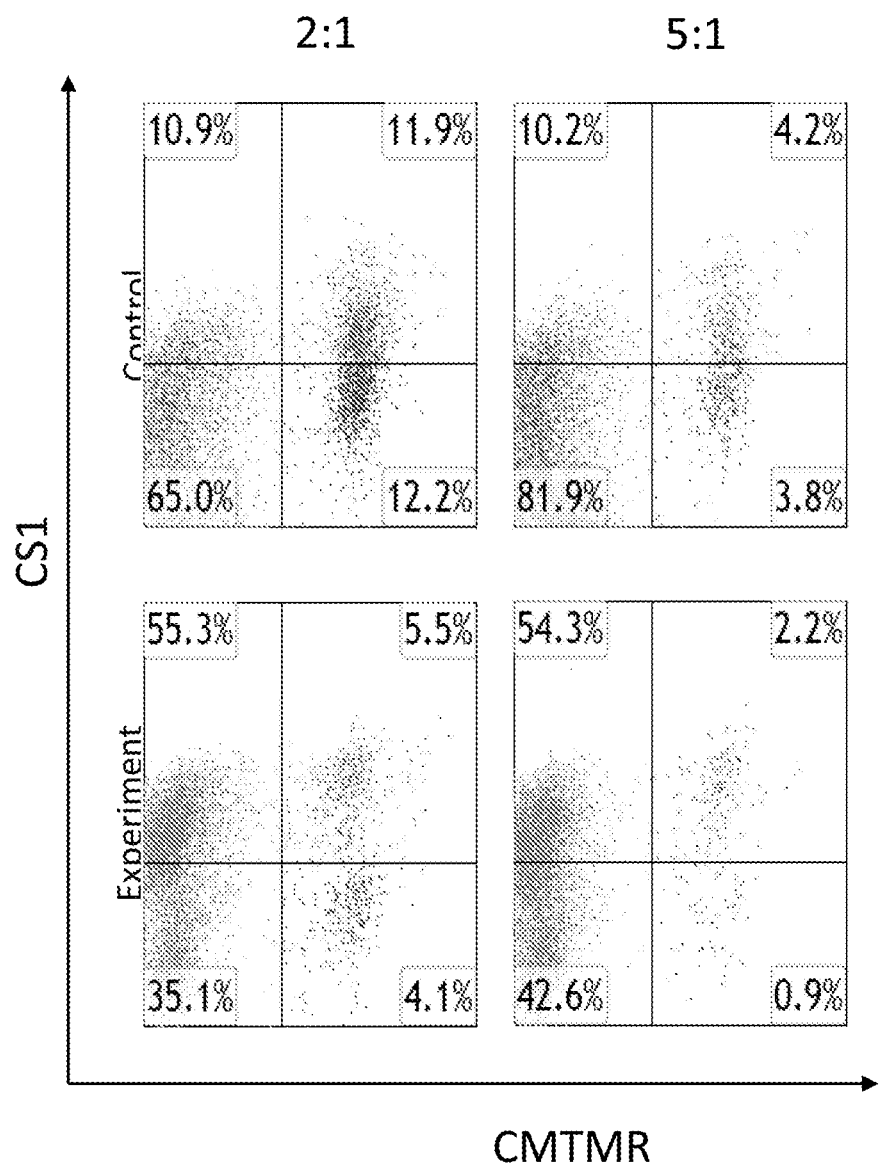
Figure 25C:
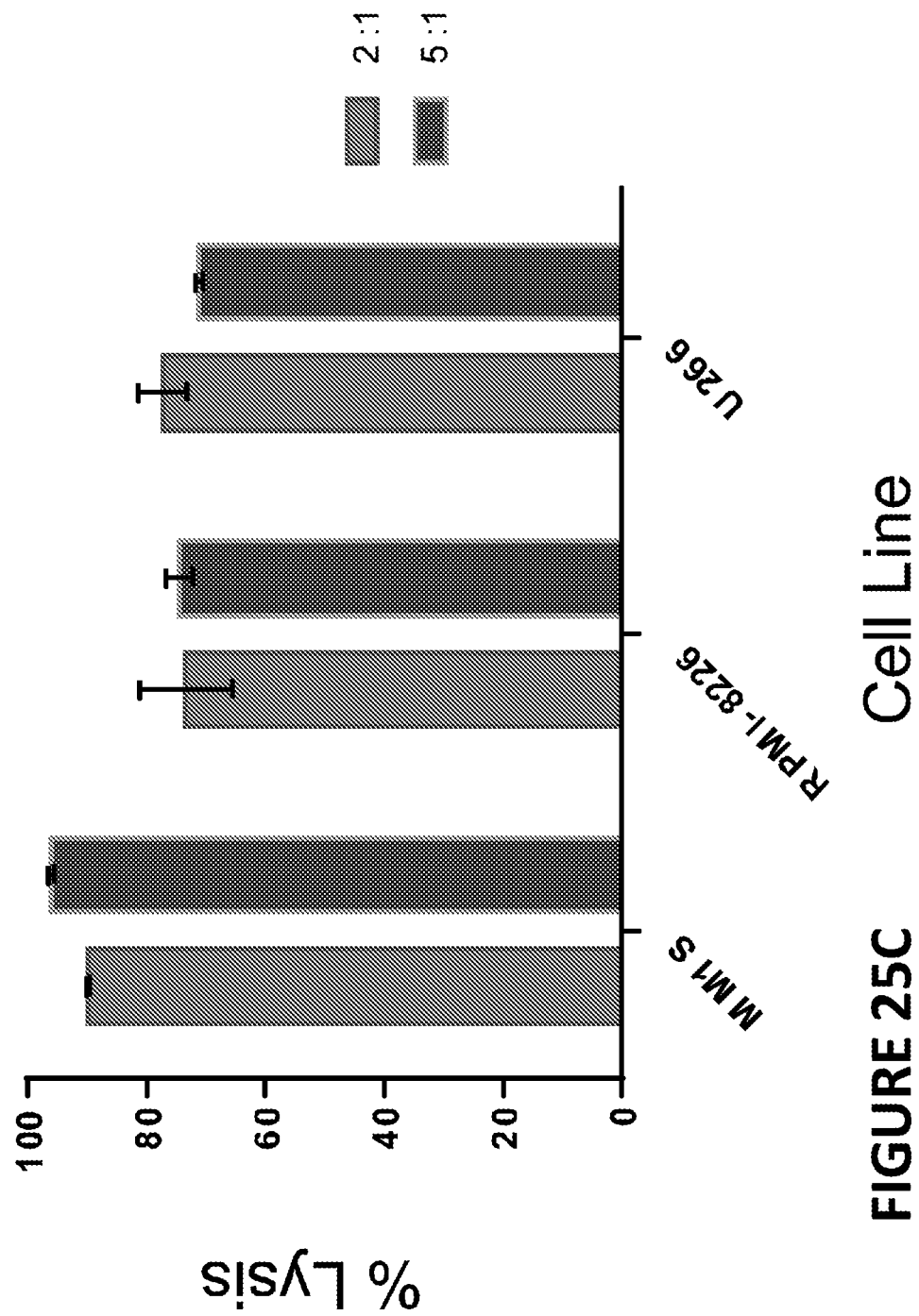

FIGS. 25A-25C. in vitro evaluation of BC1cCAR T-cells against myeloma cell lines. (25A) BC1cCAR and control T-cells were cultured with highly BCMA positive MM1S and RPMI-8226 cells for 24 hours at E:T ratios of 2:1 and 5:1. Target MM1S and RPMI-8226 cells were stained by Cytotracker dye (CMTMR) to distinguish it from effector T-cells. Populations were gated by anti-BCMA (CD269) and anti-CS1 (CD319 antibodies) along with CMTMR-PE. Target U266 cells were labeled with Cytotracker (CMTMR) dye to distinguish it from effector T-cells. (25B) U266 target depletion. BC1cCAR and control T-cells were also incubated with U266 cells expressing BCMA and a subset of CS1. Target tumor cells were stained as described above and gating conditions applied similarly. Tumor populations are encircled. (25C) In vitro summary of BC1cCAR T activity against human myeloma cell lines. Graphical summary of BC1cCAR T-cell in vitro cytotoxicity against various myeloma cell lines at 2:1 and 5:1 E:T ratios.

FIGS. 26A-26D. Characterization of BC1cCAR T-cell anti-tumor activity against primary myeloma tumor cells. (26A) Dose dependent effect on MM7-G primary double phenotype tumors. BC1cCAR and control T-cells were cultured against $BCMA^+$ $CS1^+$ primary myeloma cells MM7-G for 24 hours. Target cells were pre-stained with CMTMR and cultures were carried out in E:T ratios of 2:1, 5:1, and 10:1. Populations were gated by BCMA and CS1, along with CMTMR, and flow cytometry plots with populations encircled represent target tumor populations (left). Bar graph summarizing in vitro cytotoxicity is shown for clarity (right). (26B) Population specific depletion in MM10-G. Co-cultures with MM10-G primary tumor cells were carried out in similar conditions. When stained with anti-CS1 and anti-BCMA antibody, MM10-G reveal distinct populations. $BCMA^+$ $CS1^+$ double positive populations are colored purple whilst $CS1^+$ only populations are colored dark blue. BC1cCAR T-cell cytotoxicity against each population is summarized in the bar graph below. (26C) Dose dependent effect on CS1dim BCMAneg. MM11-G primary tumor. A third experiment using $BCMA^{dim}CS1^{dim}$ primary cells (MM11-G) further shows BC1cCAR cytotoxicity effects over a range of E:T dosages summarized. (26D) Summary panel graph showing BC cCAR T-cell cytotoxicity against myeloma cell lines and primary tumor cells with a variety of BCMA and CS1 compositions.

FIGS. 27A-27D. Functional validation of BC1cCAR antigenic specificity. (27A) We engineered a CML cell line, K562, to express either BCMA or CS1 independently. Wild-type K562 shows as a negative peak, while BCMA expressing K562 (BCMA×pK562) and CS1 expressing K562 (CS1×pK562) show population shifts in their respective antigen expression ranges. (27B) Short term (4 hour-12 hour) cultures of BC1cCAR T-cells against either BCMA×pK562 or CS1×pK562 show antigen specific cytotoxicity correlating with E:T dosage increase. Experiments against wild-type K562 were performed as a negative control. A CS1-specific single CAR was generated to compare efficacy with BC1cCAR against CS1×pK562 cells and are delineated with red bars in the respective plot. Anti-CS1 specific activity was also seen against $CS1^{dim}$ NK-92 cells after 24 hours of culture. (27C) Comparison between single antigen CARs and BC cCAR T in mixed cell assays. Long-term cultures were conducted over a 48 hour period with a 5:1 mixture of BCMA×pK562 cells and CS1×pK562 cells. BC1cCAR, CS1-CAR, BCMA-CAR, and control T-cells were added at a 5:1 E:T ratio to each treatment well and flow cytometry analyses acquired. Histogram plots showing residual populations of BCMA or CS1 cells are shown per treatment condition, with red lines demarcating T-cell or target tumor populations. Numerical values in histogram plots represent residual gated populations of target tumor cells. (27D) BC1cCAR T activity against CS1 subsets in primary bone-marrow aspirate. Further co-culture experiments were conducted using bone-marrow aspirate samples as CS1 expressing minority subsets. BC cCAR or control T-cells were added at 2:1 (left panel), 5:1 (middle panel), or 10:1 (right panel) ratios and encircled populations represent target CS1 expressing populations. Results are analyzed by flow cytometry (upper). Summary graph of anti-CS 1 activity against bone marrow subsets (below).

Figure 28A:
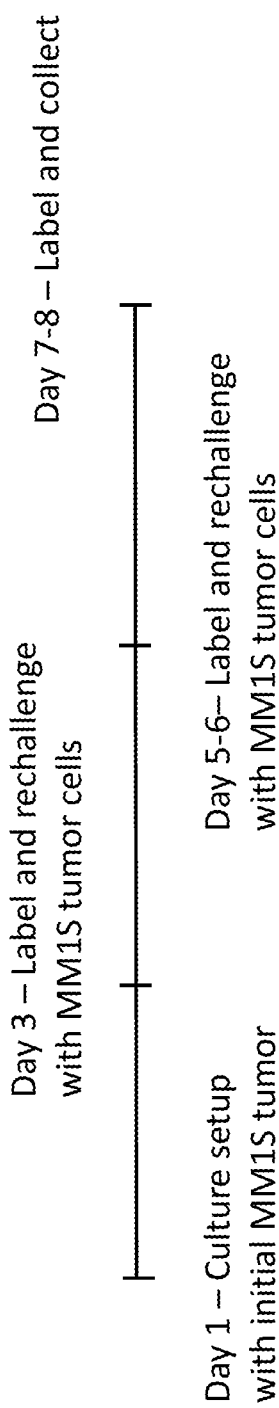
Figure 28B:
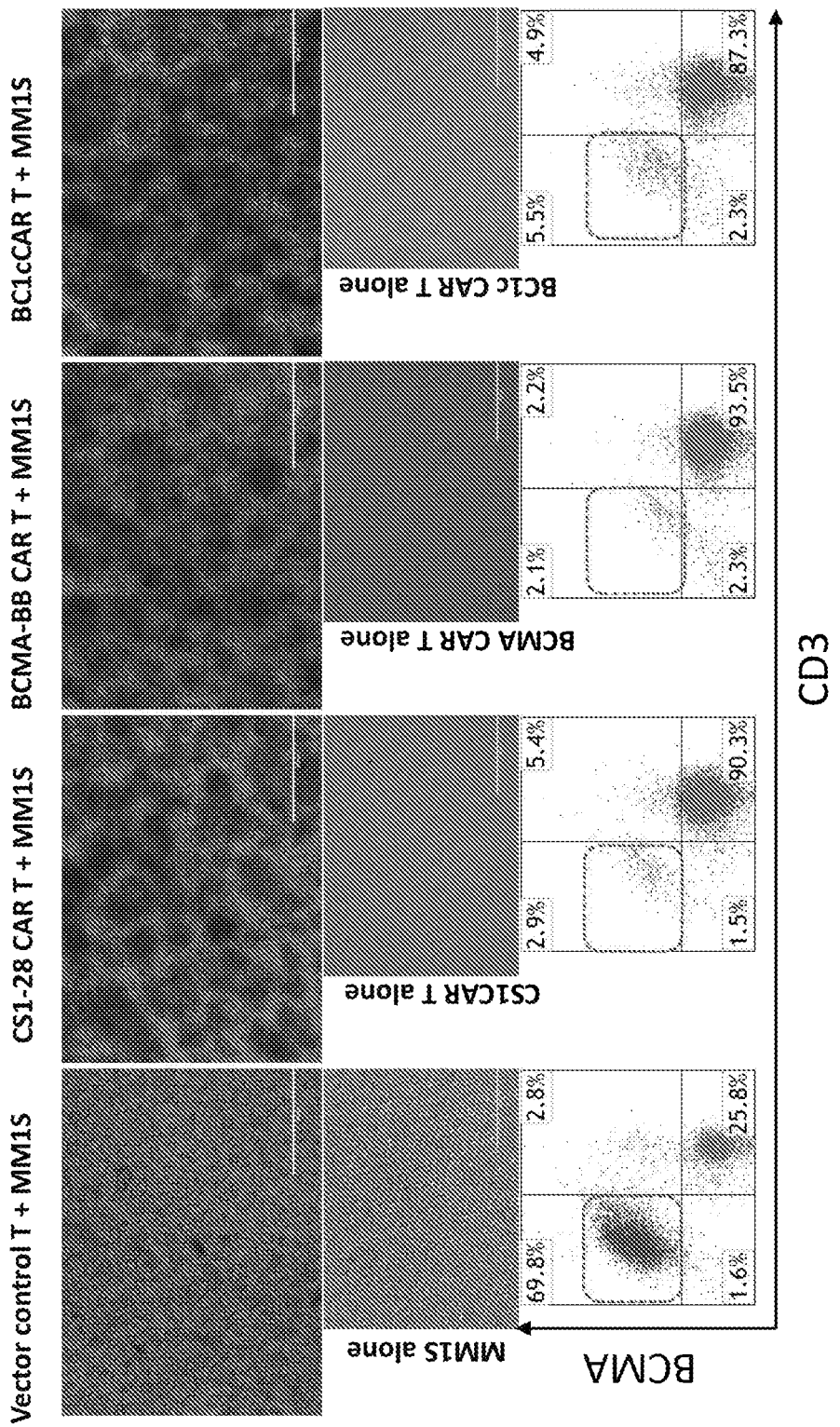
Figure 28C:
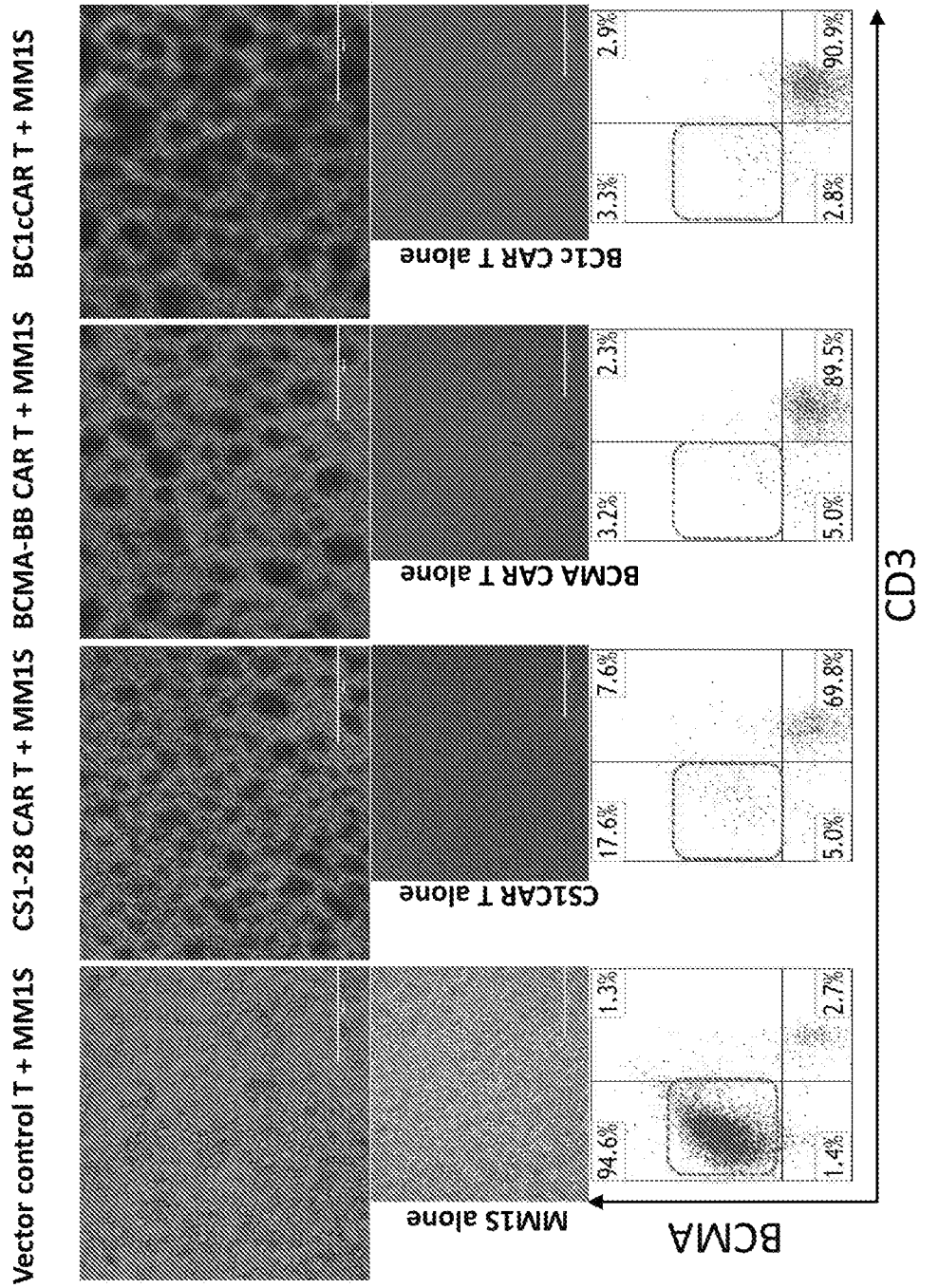

FIGS. 28A-28C: Long-term sequential killing assay and tumor re-challenge. (28A) Scheme for construction of long-term sequential killing assay. Assay was conducted over a period of 168 hours with no exogenous cytokines where the initial culture was set-up with a 1:1 E:T ratio of CAR cells or control cells mixed with MM1S tumor cells. After 48 hours, flow cytometry analysis was acquired for a small sample collection and MM1S cells re-introduced into each treatment well. Repeated until the 168 hour time-point. (28B) T-cell proliferation and response after 48 hours. Images were taken on day of flow cytometry acquisition and cells were stained with anti-BCMA, anti-CS1, and anti-CD3 antibodies MM1S cells express as highly $BCMA^+$ with a large $CS1^+$ proportion. Encircled populations represent the MM1S tumor presence, colored blue. (28C) CAR cell proliferation and antigen depletion after 108h. Similar image acquisition and flow cytometry analysis was performed at the 108 hour time mark.

Figure 29A:
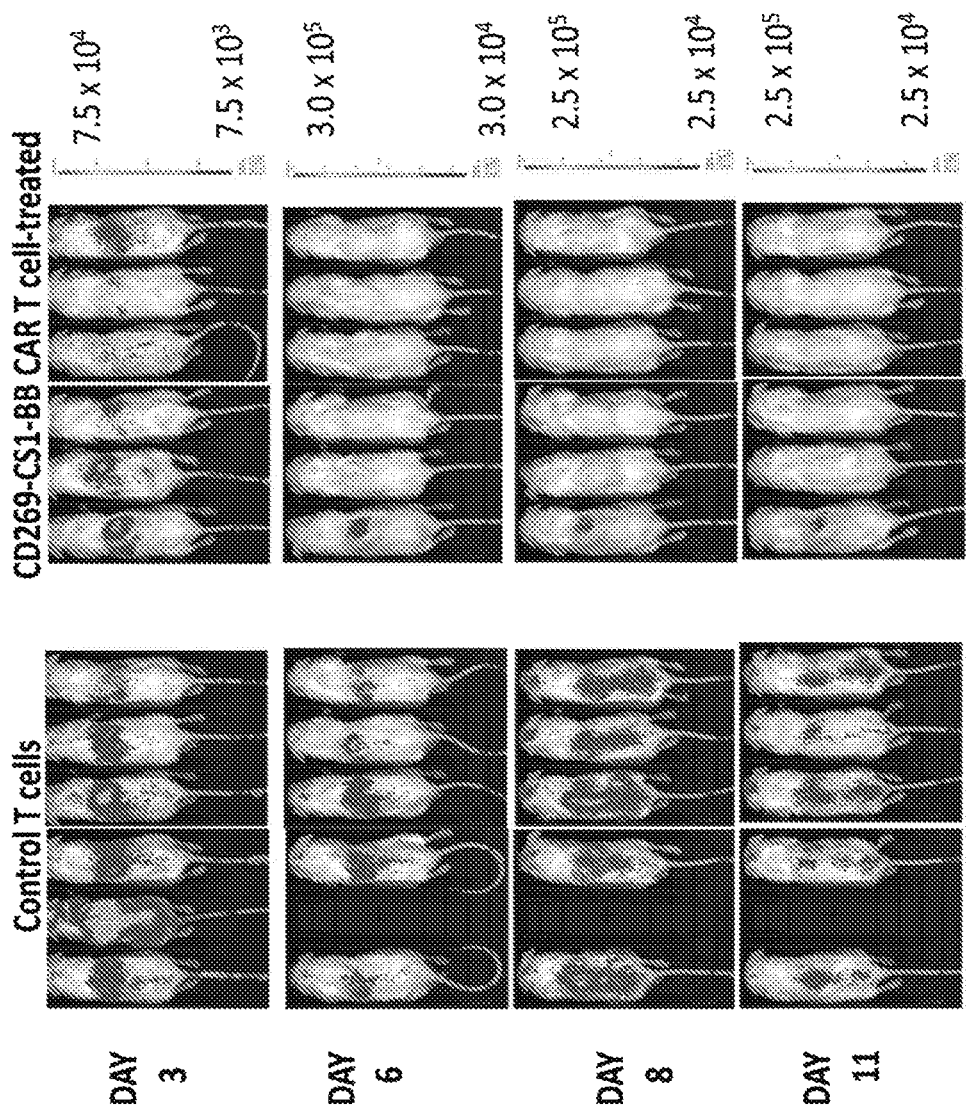
Figure 29B:
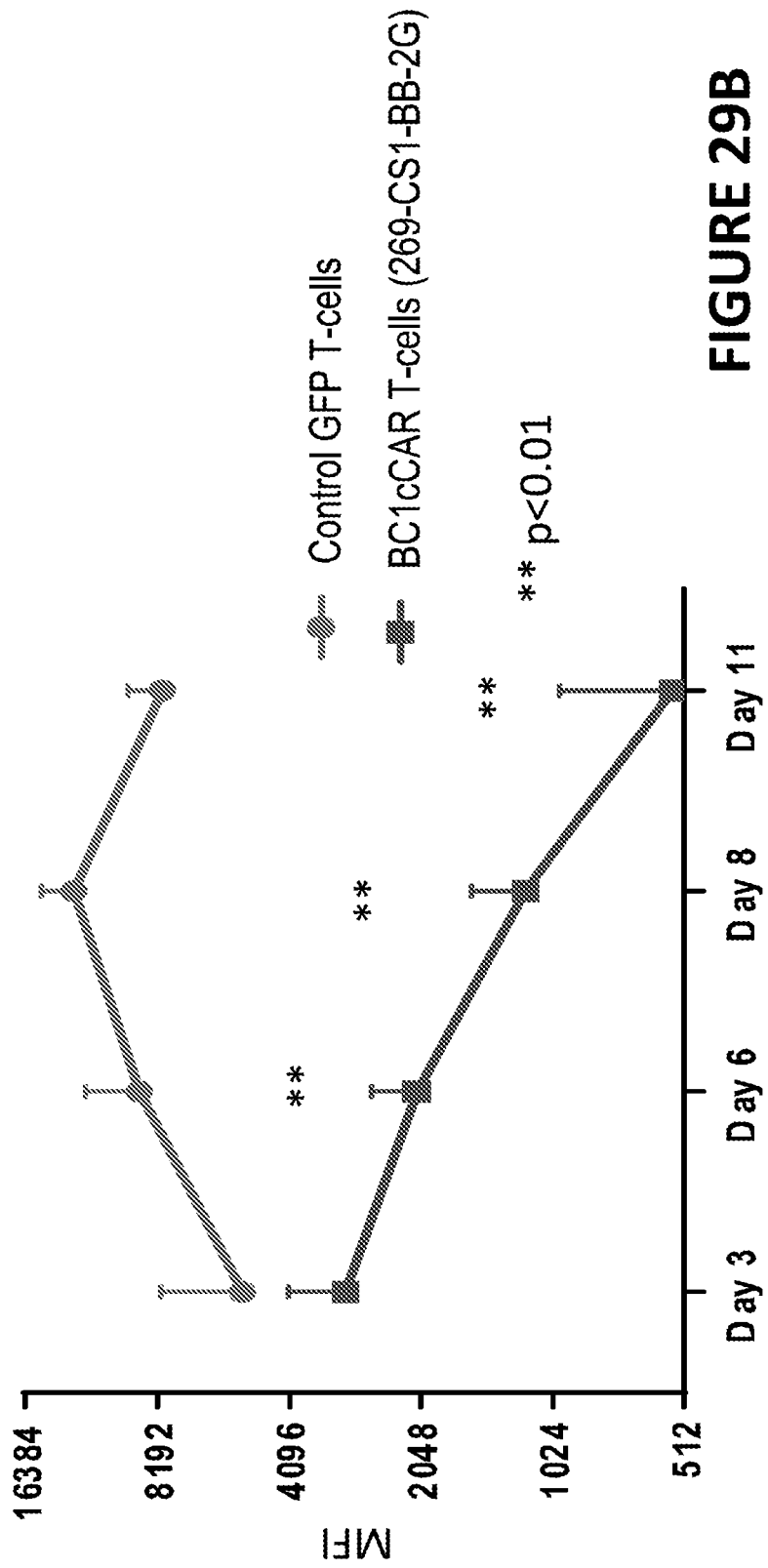
Figure 29C:
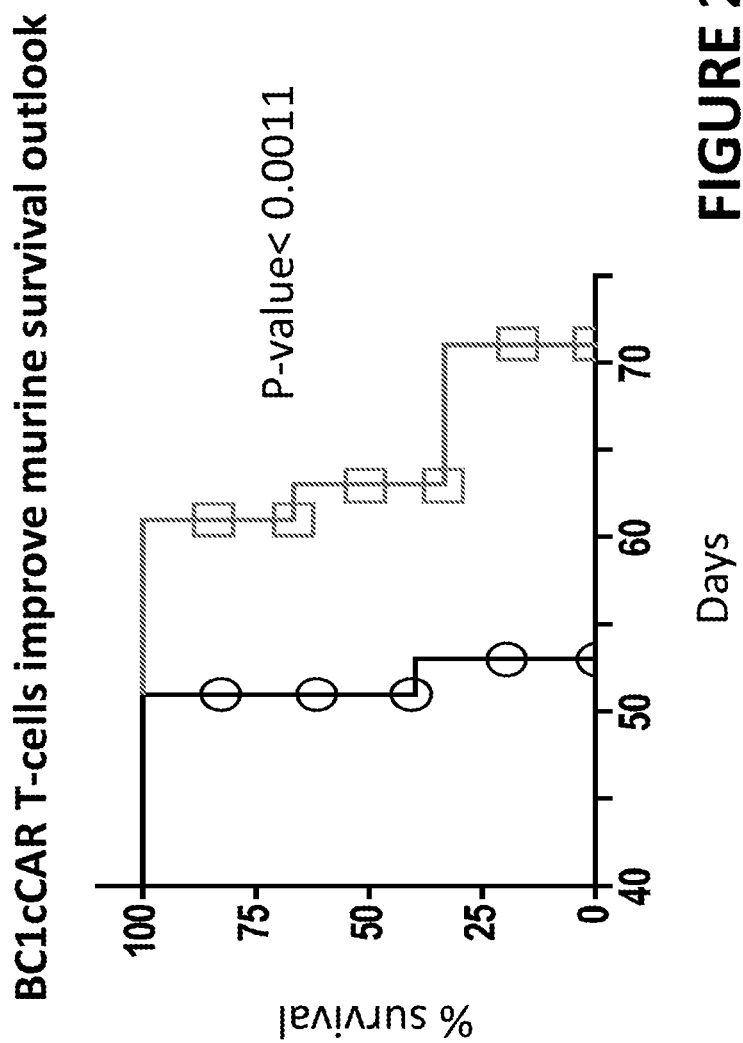

FIG. 29A-29C. BC1cCAR T-cells demonstrate anti-leukemic effects in vivo. (29A) IVIS imaging of MM1S Luc+ injected mouse model. NSG mice were sublethally irradiated and intravenously injected with luciferase-expressing MM1S multiple myeloma cells to induce measurable tumor formation. After 3 days, the mice were intravenously injected with $5 \times 10^6$ BC1cCAR T-cells or control GFP T-cells. On days 3, 6, 8 and 11, mice were injected subcutaneously with RediJect D-Luciferin and subjected to IVIS imaging. (29B) BC1cCAR T-cells control MM1S tumor growth. Average light intensity measured for the BC1cCAR T-cells injected mice was compared to that of GFP control T-cell injected mice. (29C) BC1cCAR T-cells improve murine survival outlook. Percent survival of mice was measured and compared between the two groups and log-rank mantel-cox test was conducted to calculate significance of improved survival outlook.

Figure 29D:
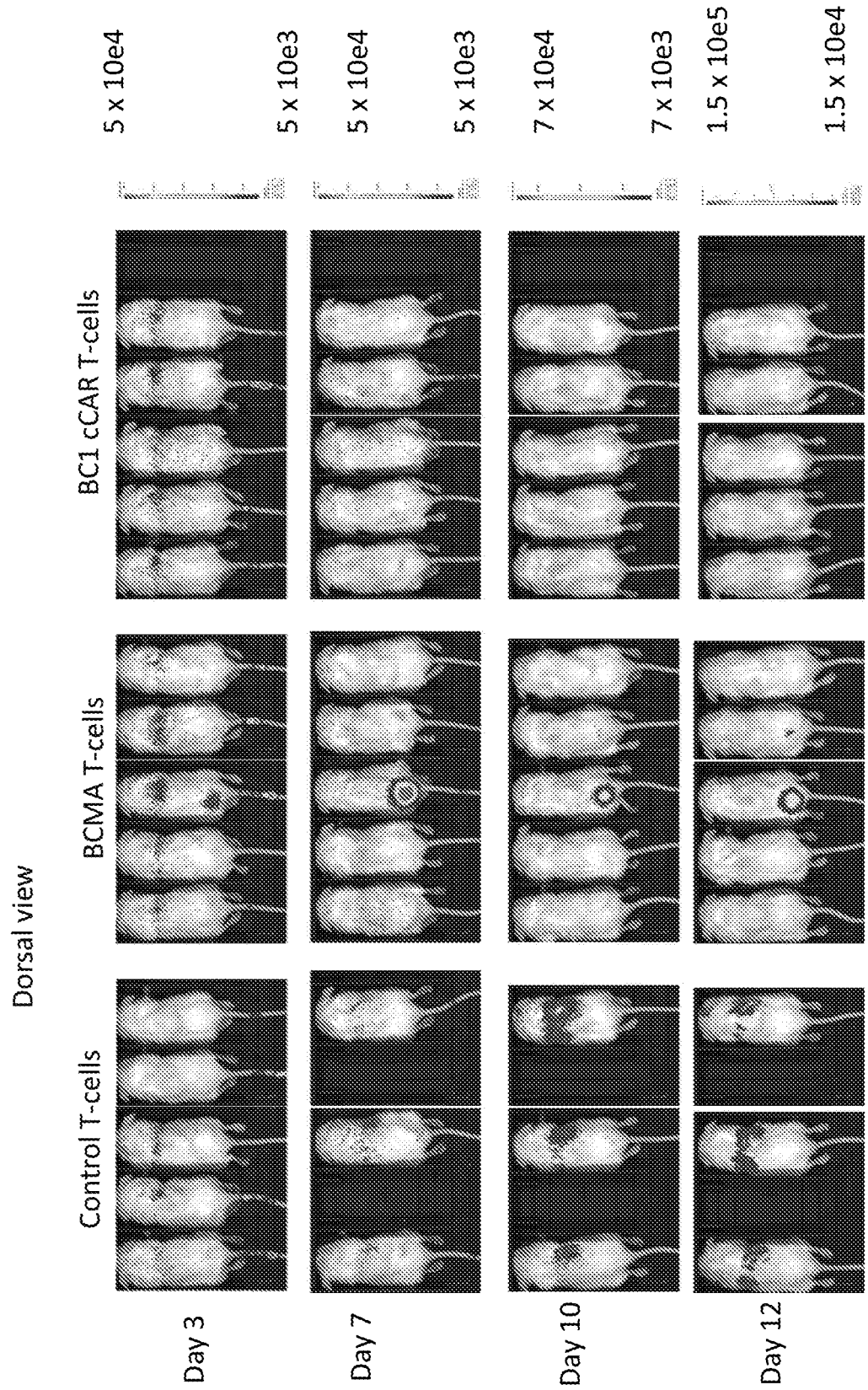
Figure 29E:
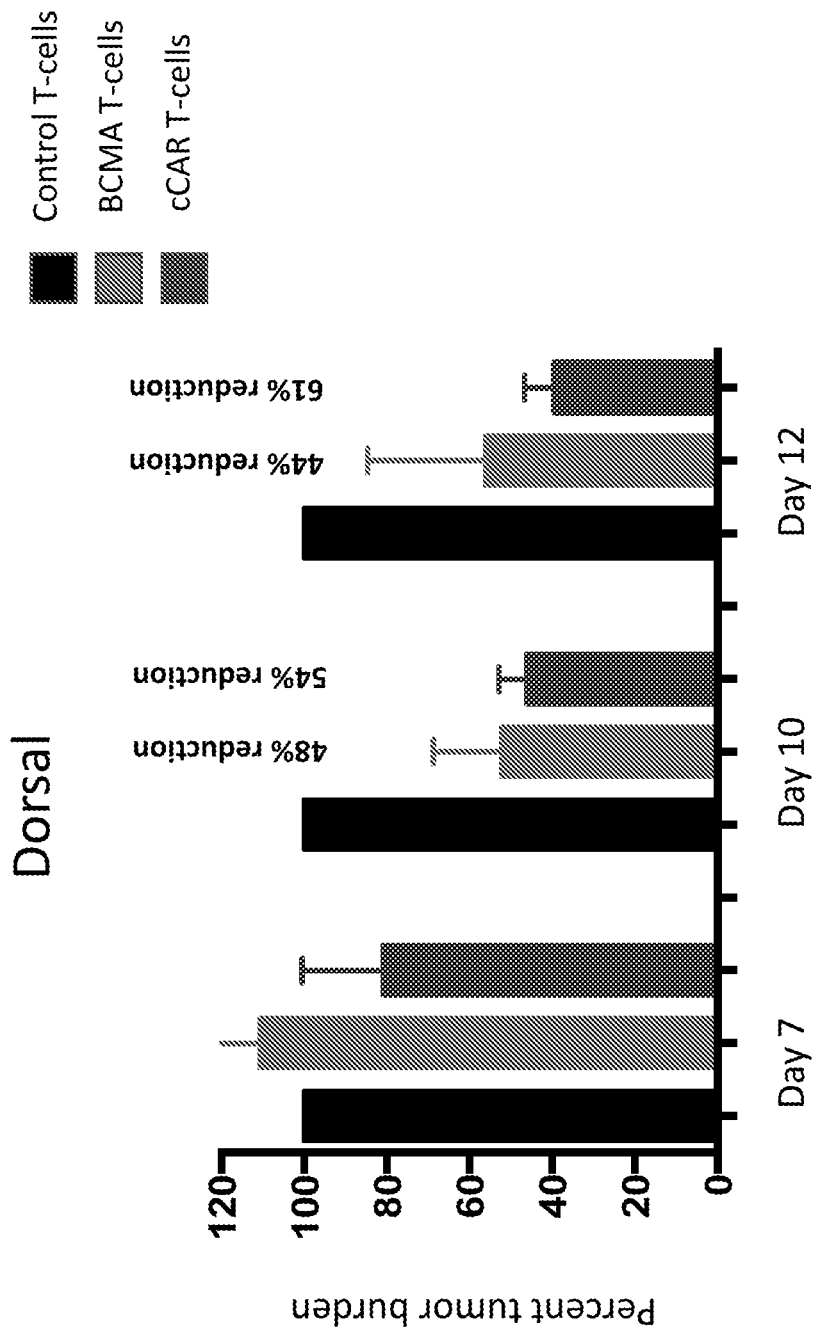

FIG. 29D. BCMA-CAR and BC1 cCAR T-cells demonstrate a profound anti-leukemic effect on a mixture of K562 cells expressing BCMA and CS1 in xenograft mouse model. Luciferase positive K562 cells expressing BCMA are mixed with luciferase positive K562 cells expressing CS1 at a ratio of 4:1 BCMA to CS1 K562 cells. The mixed K562 cells ($0.5 \times 10^6$ cells) were then injected intravenously (day 1) at 24 h later after sub-lethal irradiation. After day 3, a course of BCMA CAR T-cells, BC1cCAR T-cells or control T-cells were intravenously injected into each mouse (n=5 for each group). Dorsal side of tumor burden was measured using IVIS imaging system at days 3, 7, 10 and 12. At day 7 BCMA mouse #3 has large tumor. At day 10 Dorsal BCMA vs. control=47.7% less tumor, cCAR vs. control=53.8% less tumor. At day 12 RESULTS (ventral view only) Dorsal BCMA vs. control=43.8% less tumor, cCAR vs. control=60.7% less tumor FIG. 29E. BCMA and BC1 cCAR T-cells in vivo significant reduction of tumor burden. Percent reduction relative to control in mice treated with BCMA CAR T-cells or cCAR (BC1 cCAR) relative to control over time.

Figure 30A:
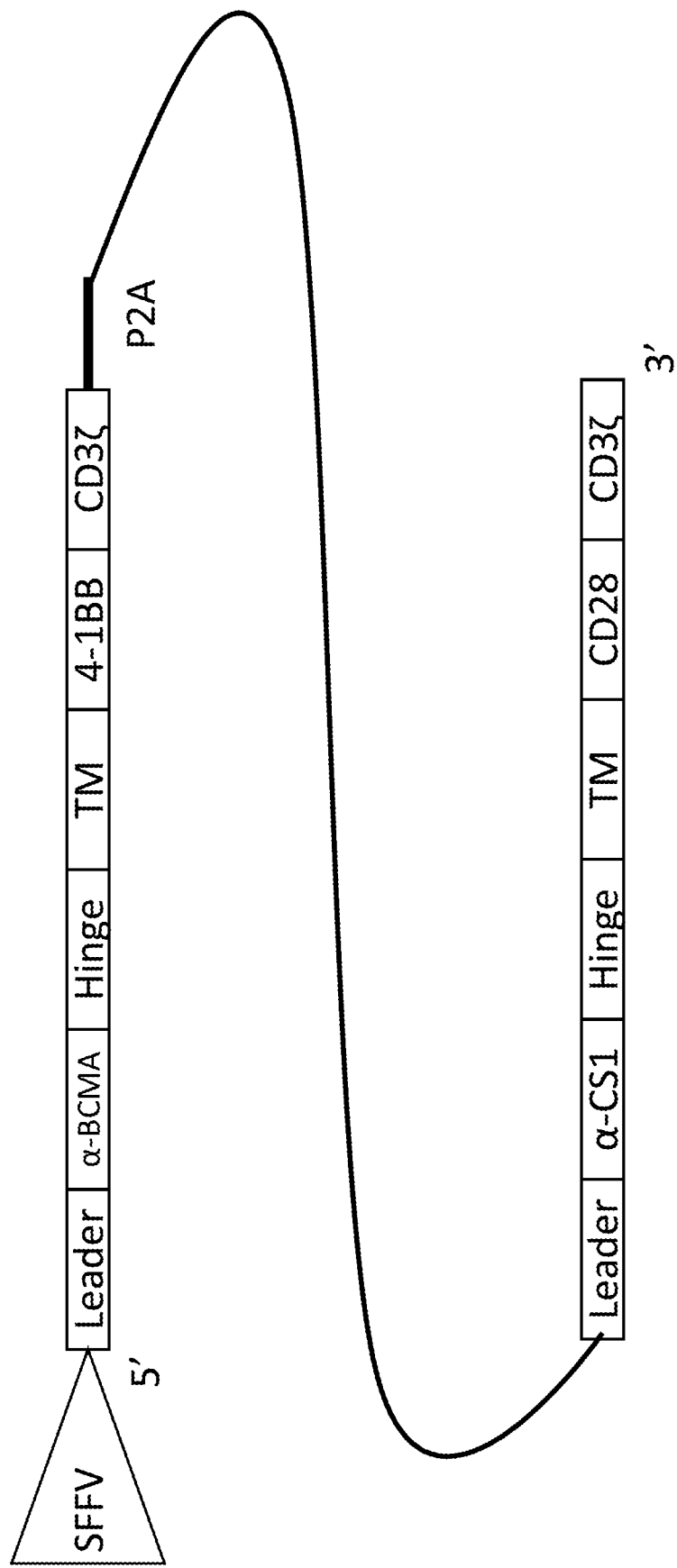
Figure 30B:
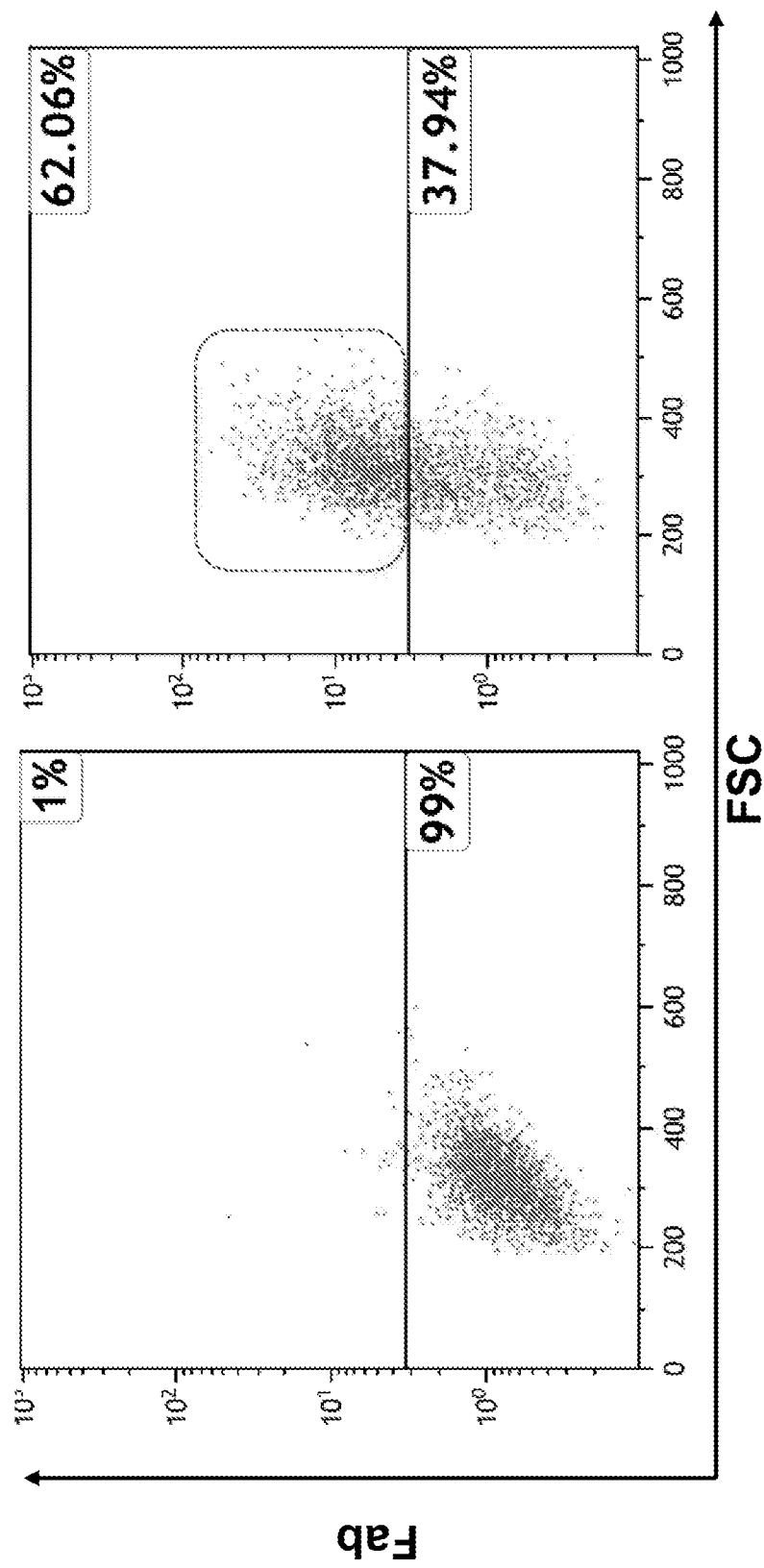

FIGS. 30A-30B: BC1cCAR transduction into NK-92 cells. (30A) BC1cCAR's modular design is comprised as shown and described previously. (30B) CAR expression on NK-92 cell surface. The construct was transduced into NK-92 cells by incubating with viral supernatant for 48 hours and labeling with F(ab)' antibody detection for CAR protein surface expression. Transduced populations are encircled and compared to control NK-92 cells.

Figure 31A:
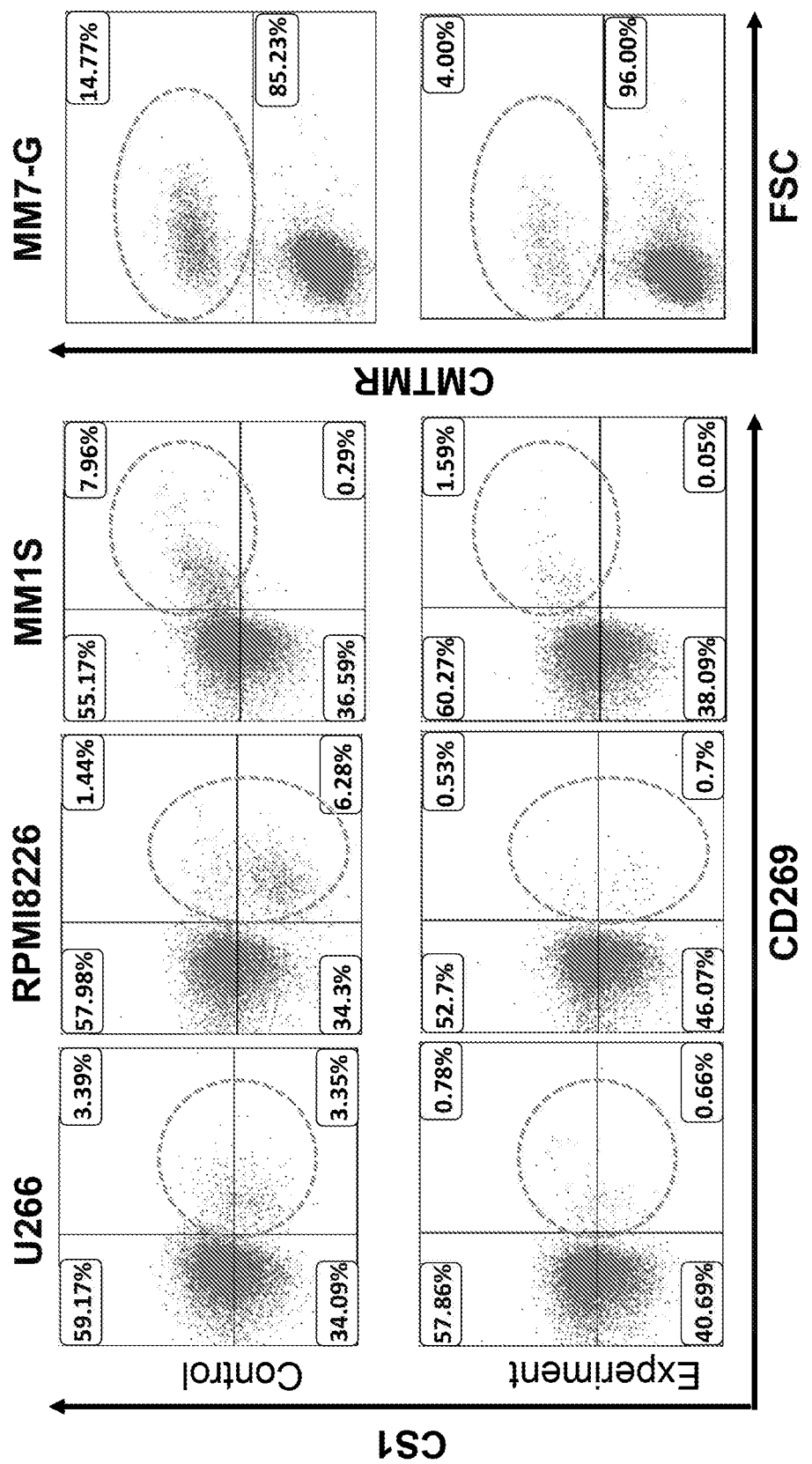
Figure 31B:
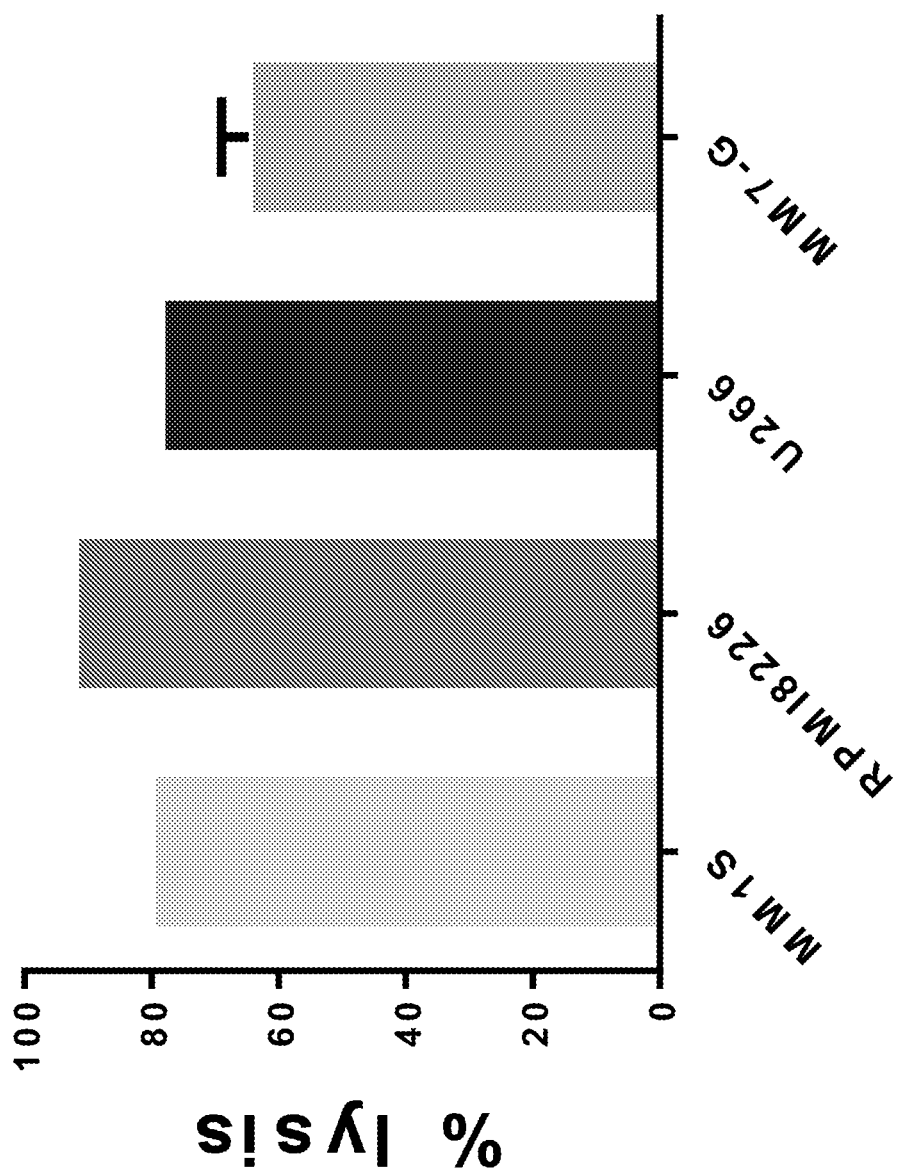

FIGS. 31A-31B. Characterization of BC1cCAR NK-92 anti-tumor properties. (31A) BC1cCAR NK cells lyse myeloma cell lines and primary cells. BC1cCAR NK-92 cells were incubated against U266, RPMI-8226, and MM1S myeloma cell lines in addition to primary MM7-G tumor cells. Co-cultures were carried out over 2 hours at an E:T ratio of 5:1 and labeled with anti-CS1 and anti-BCMA antibodies to separate out populations. Tumor populations are encircled. MM7-G primary tumor cells were stained with cell cytotracker dye (CMTMR) to distinguish from NK-92 cells and are encircled. Summary bar graph of BC1cCAR NK-92 cytotoxic activity is presented (31B). (31C) BC1cCAR NK-92 cells were tested for antigen specific activity using artificially generated BCMA expressing K562 (BCMAxpK562) and CS1 expressing K562 (CS1xpK562) cells. Co-cultures were carried out over 4 hours at an E:T ratio of 5:1. K562 populations were previously stained with CMTMR and encircled in the flow cytometry plots. Bar graph summarizing anti-tumor activity to visualize.

Figure 32A:
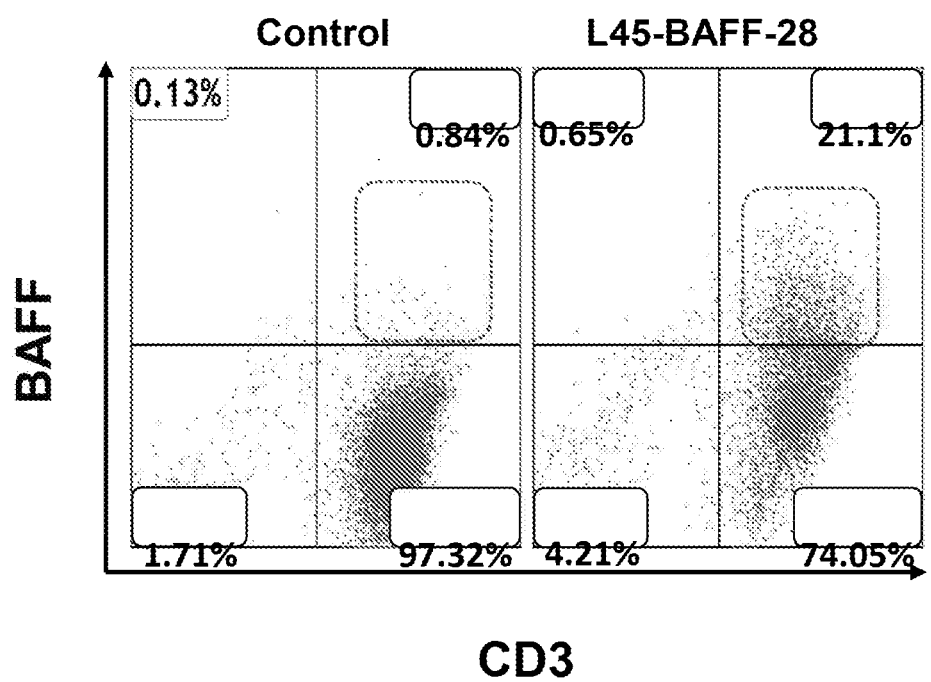
Figure 32B:
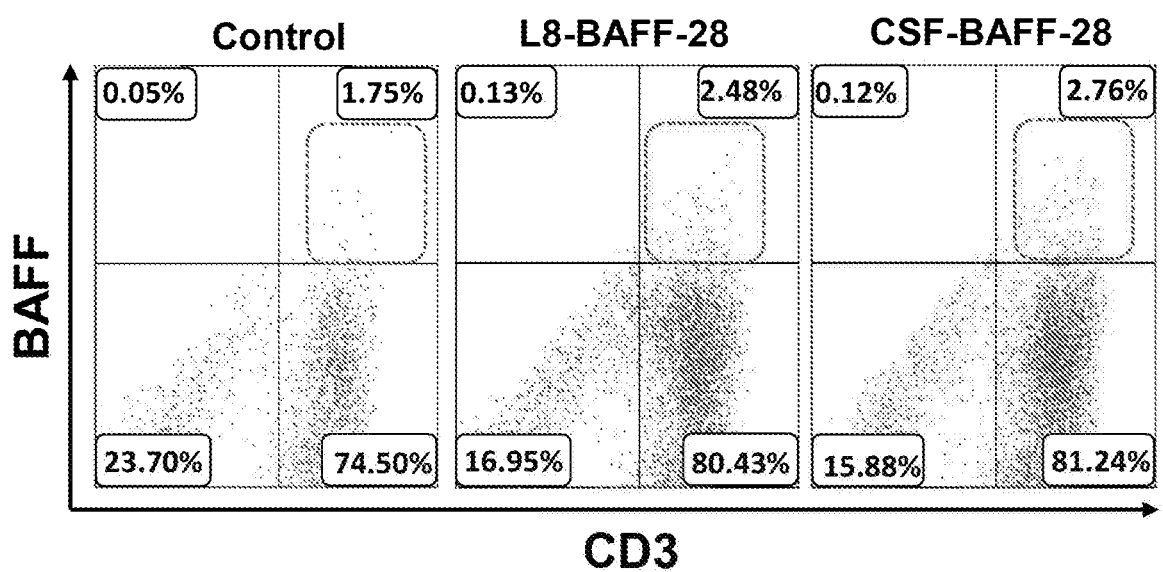
Figure 32C:
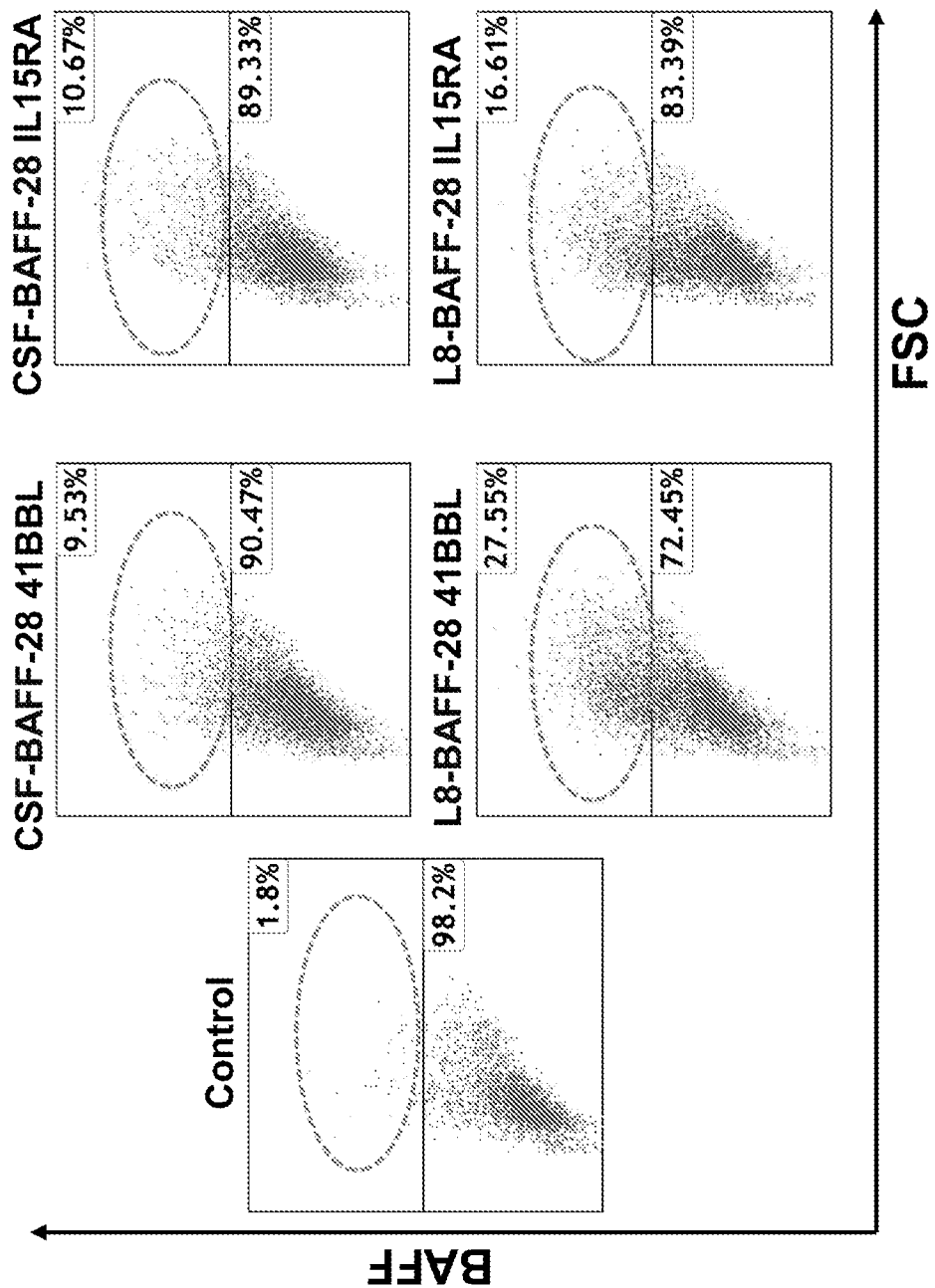

FIGS. 32A-32C. Generation and characterization of different BAFF-CAR constructs. (32A) L45-BAFF-28 CAR expression T-cell surface. L45-BAFF-28 CAR was transduced into T-cells and evaluated for surface expression using F(ab)' antibody. Gating was compared to controls. (32B) CAR expression dependence on leader sequence. BAFF-CAR constructs using different leader sequences were tested to determine if efficiency in transduction could be improved. Surface detection was evaluated using F(ab)' antibody and transduced populations encircled. (32C) CAR expression dependence on construct design. Additional BAFF-CAR constructs containing different leader sequences and construct designs (additional units) were validated and used to determine if CAR transduction could be improved. Transduced populations are encircled and gating compared to control T-cells. CSF-BAFF-28 41BBL is a BAFF CAR co-expressing 4-1BBL (41BBL) with a CSF leader sequence. CSF-BAFF-28 IL-15RA is a BAFF CAR co-expressing IL-15/IL-15sushi (IL-15RA) with a CSF leader.

Figure 33:
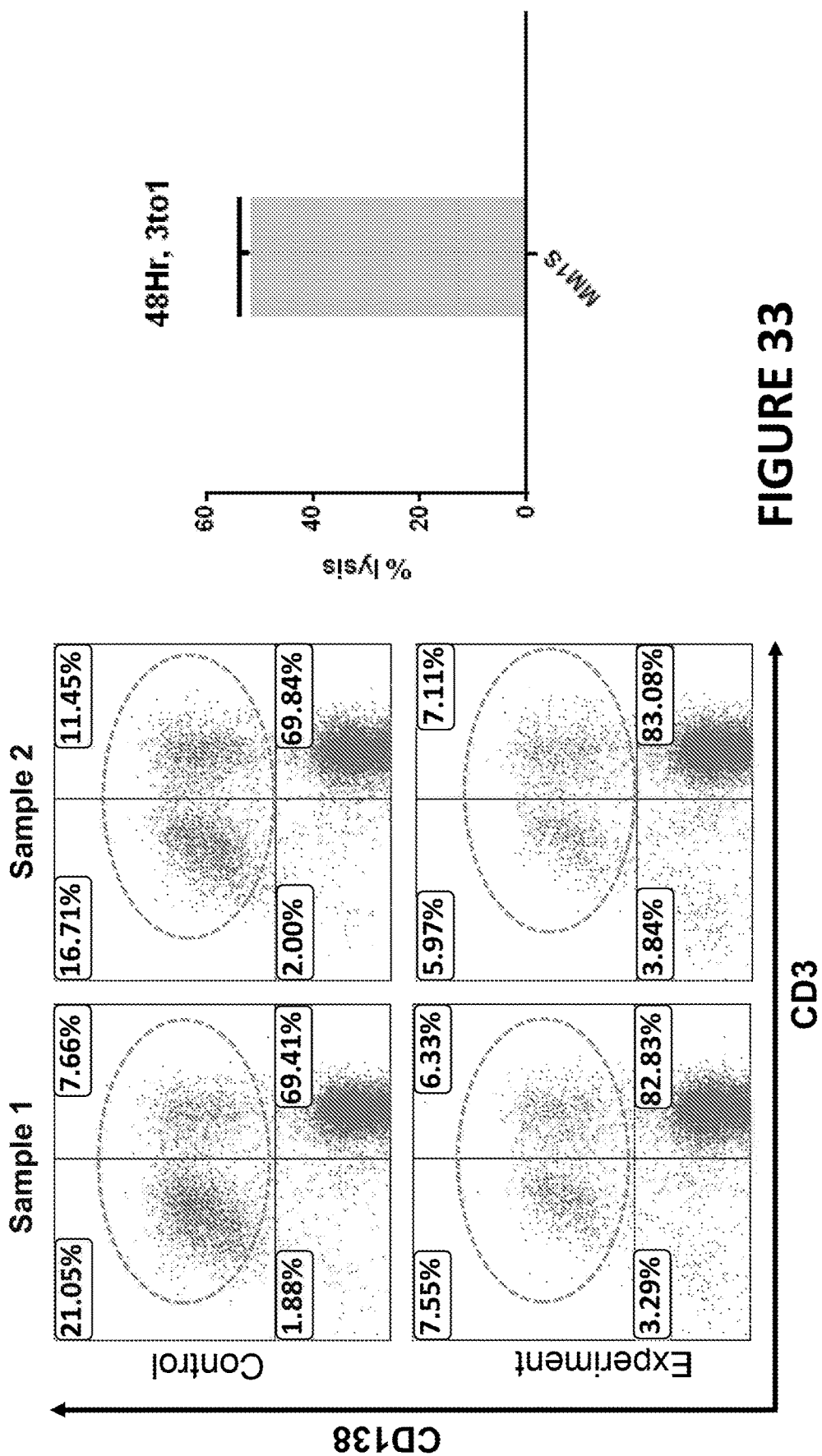

FIG. 33: Characterization of L45-BAFF-28 CAR T anti-tumor properties. L45-BAFF-28 CAR T-cells possess anti-tumor activity against MM1S tumor cells. L45-BAFF-28 CAR T-cells were cultured for 48 hours at an E:T ratio of 3:1 against MM1S myeloma cells. Duplicate samples are shown. Cytotoxic activity is summarized in the bar graph.

Figure 34A:
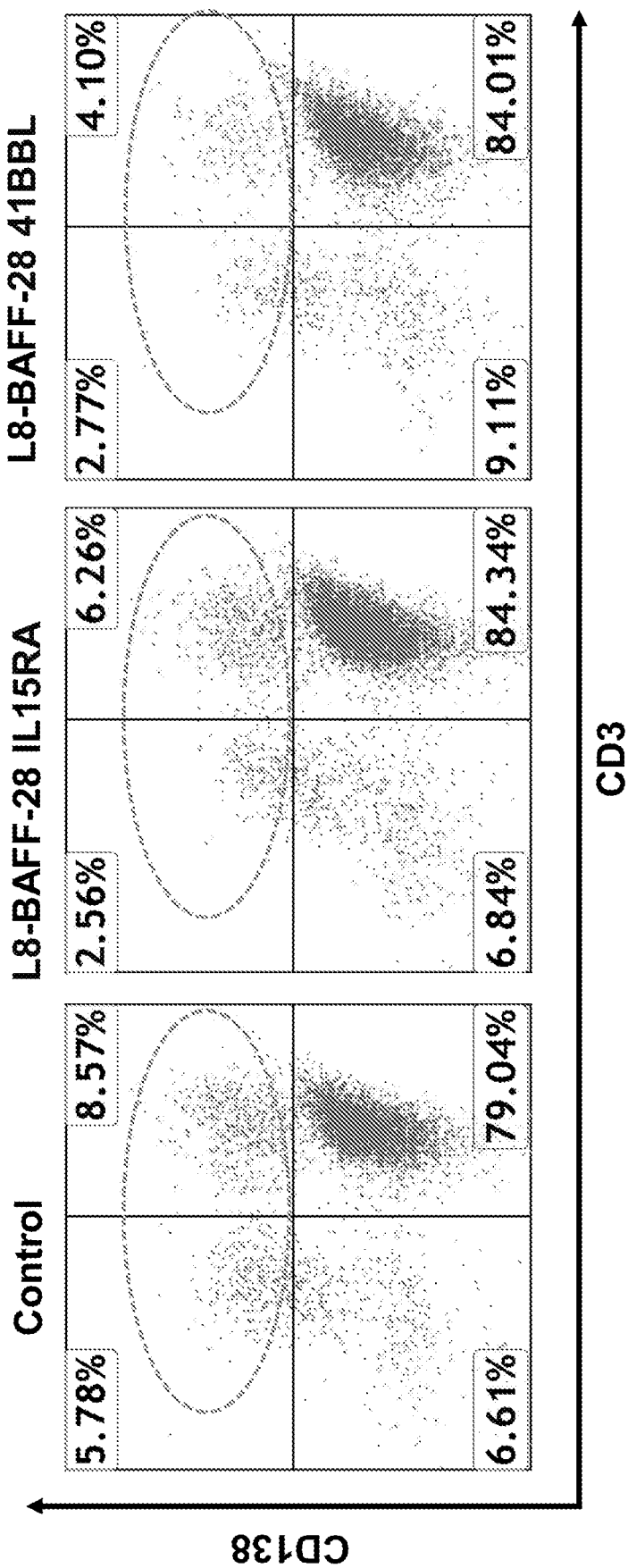
Figure 34B:
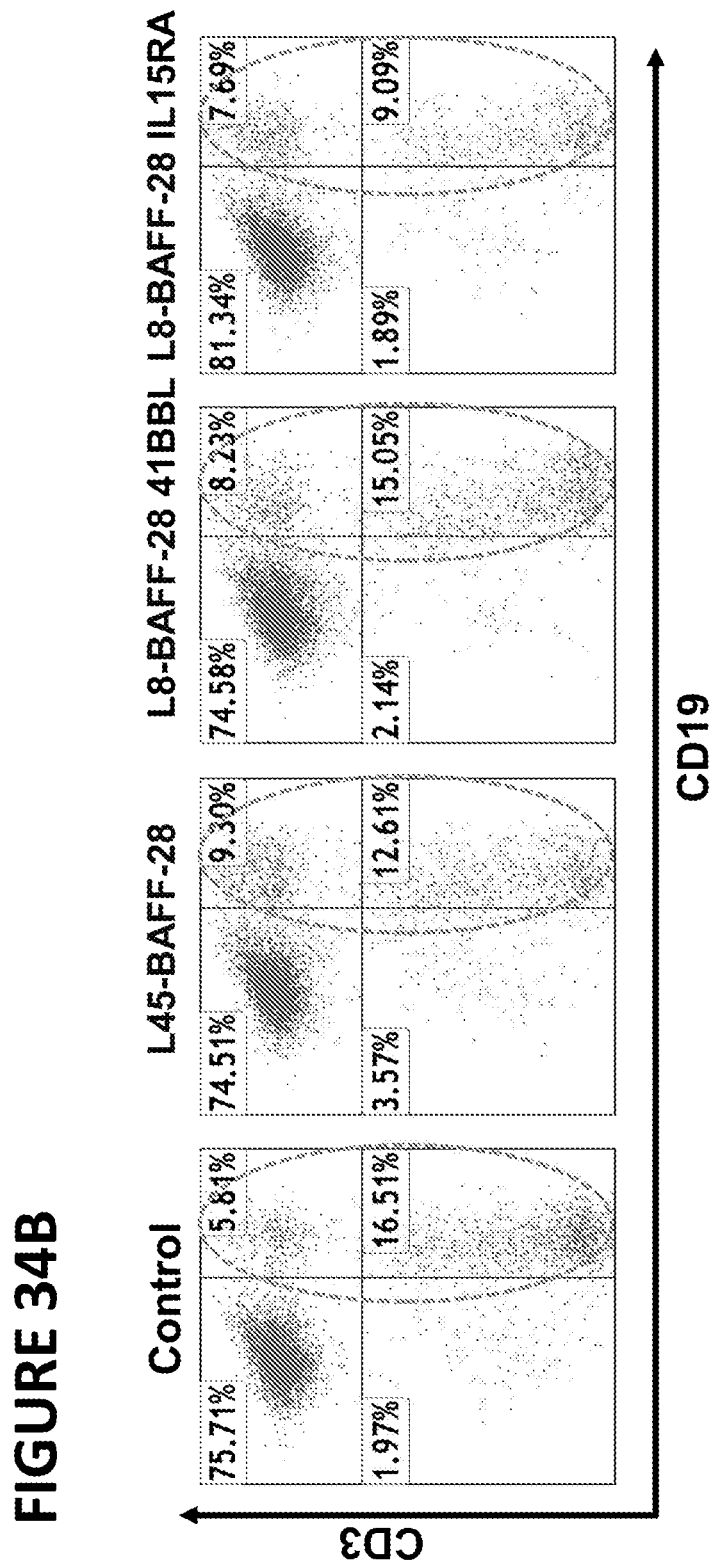
Figure 34C:
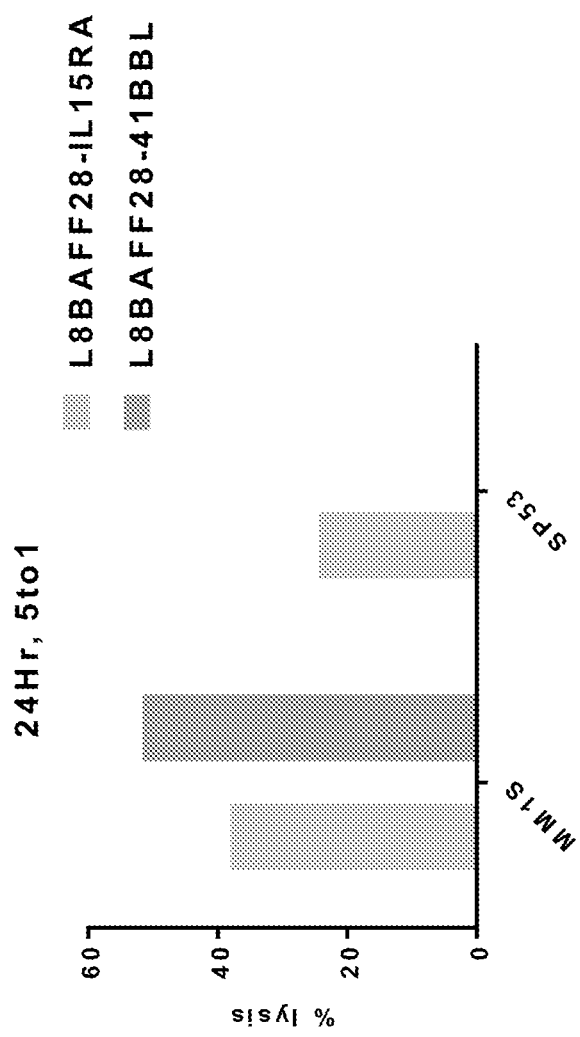

FIGS. 34A-34B: Characterization of anti-tumor activity using different BAFF-CAR constructs and enhancements. (34A) BAFF-CAR constructs against MM1S cells. L8-BAFF-28IL-15/IL-15sushi and L8-BAFF-28-41BBL CARs were cultured for 24 hours against MM1S tumor cells at an E:T ratio of 5:1. Tumor populations are encircled. (34B) BAFF-CAR constructs against SP53 cells. Both CARs and L45-BAFF-28 CAR were cultured against Sp53 tumor cells (B-lineage) at an E:T ratio of 5:1 for 24 hours. (34C) Summary bar graph of cytotoxic activity.

Figure 35:
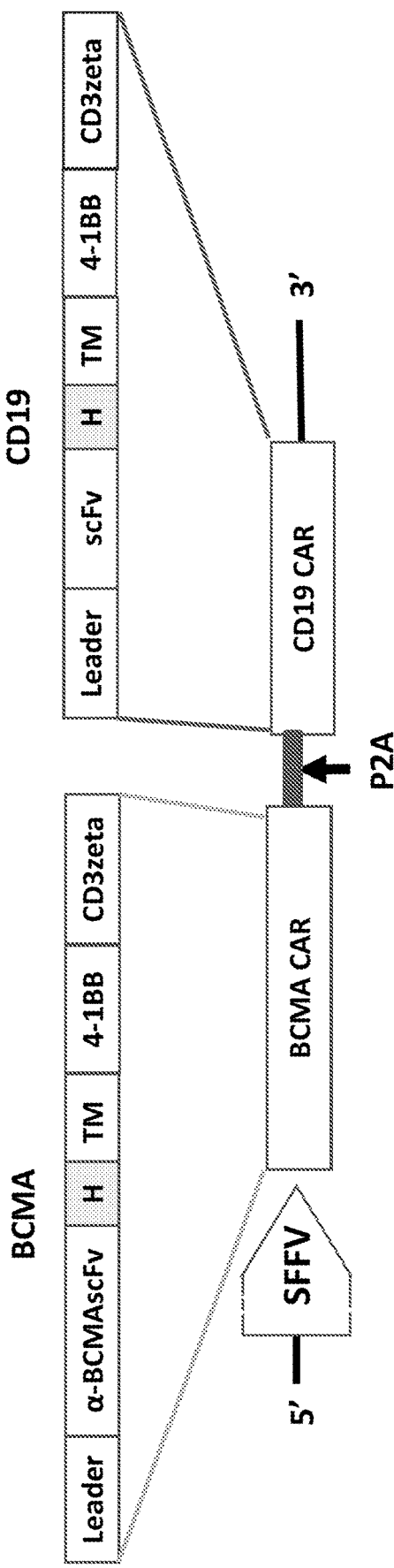

FIG. 35. A schematic showing cCAR construct. The construct consists a SFFV promoter driving the expression of two modular units of CAR linked by a P2A peptide. Upon cleavage of this P2A peptide, the cCARs split and engage upon targets expressing BCMA and/or CD19. Two unit CARs use different or same co-stimulatory domain. A co-stimulatory domain could be, but limited to, 4-1BB or CD28.

Figure 36A:
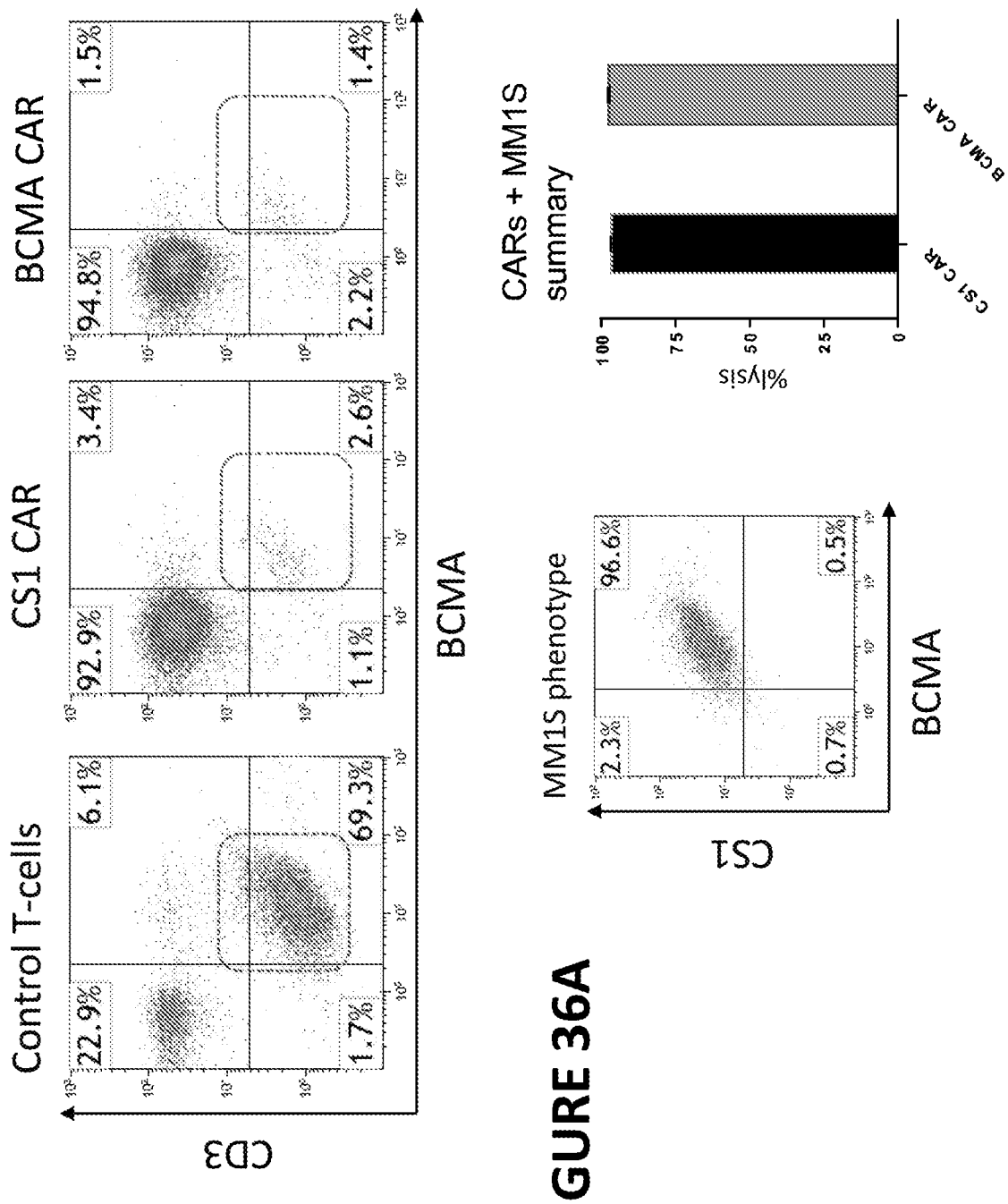
Figure 36B:
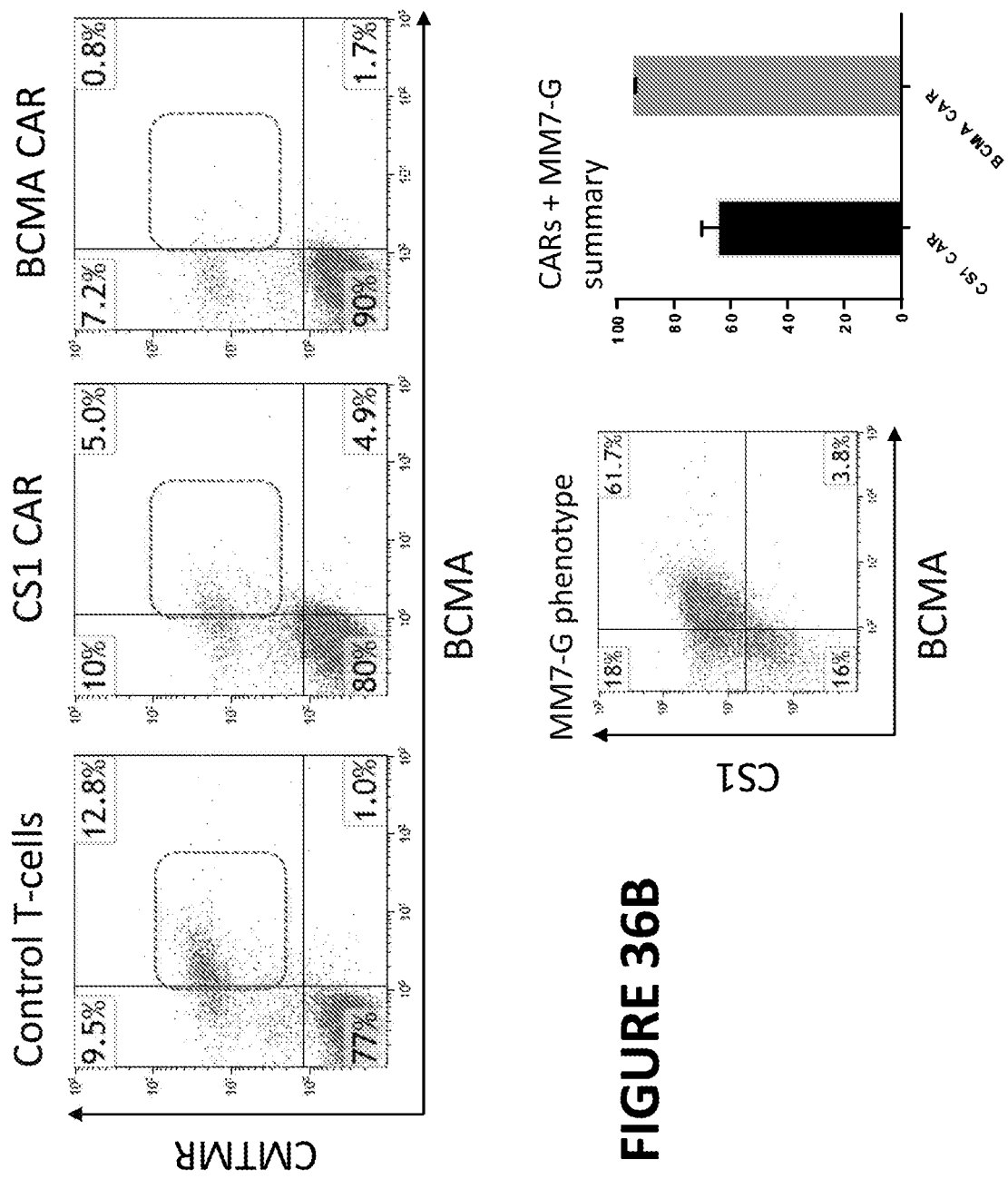

FIGS. 36A-36B. Characterization of the BCMA CAR unit. (36A) BCMA CAR effectively deplete BCMA+ MM1S cells. The BCMA CAR was transduced into T-cells and co-cultured with MM1S tumor cells. A CS1 CAR was also generated and used for robustness. MM1S cells are significantly dual positive for both BCMA and CS1. Co-cultures were conducted over 48 hours with BCMA and CS1 antibodies used to identify tumor centers. Encircled populations represent residual MM1S tumor cells after culture. (36B) BCMA CAR effectively lyses BCMA+ primary tumor cells. (36B) The BCMA CAR and CS1 CAR were also evaluated for its anti-tumor properties against primary MM7-G myeloma patient cells. The MM7-G population is a majority $BCMA^+$ $CS1^+$ population with minority but significant $CS1^+$ only populations as well. Both BCMA CAR and CS1 CAR were used in tandem to evaluate cytotoxicity with BCMA and cytotracker (CMTMR) used to differentiate tumor populations from CAR cells.

Figure 37A:
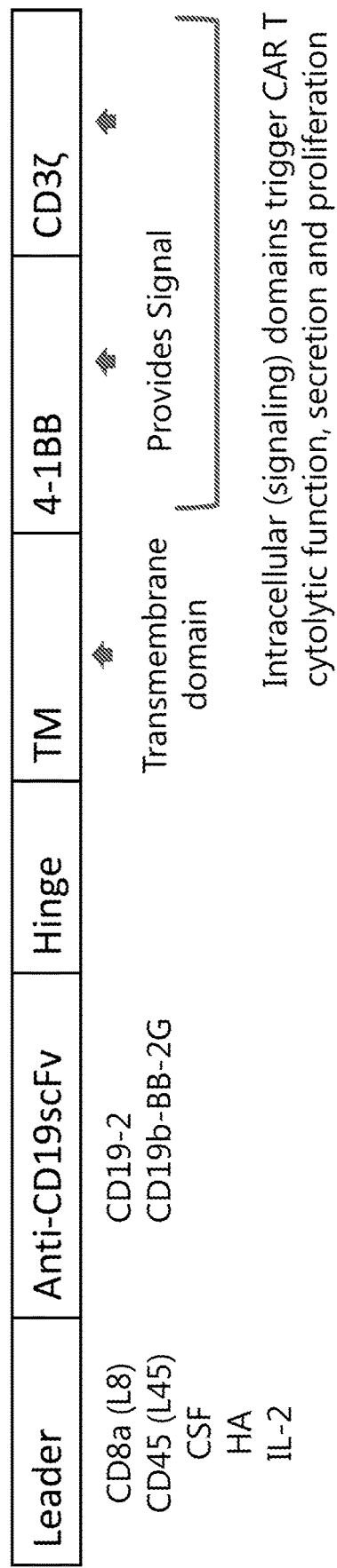
Figure 37B:
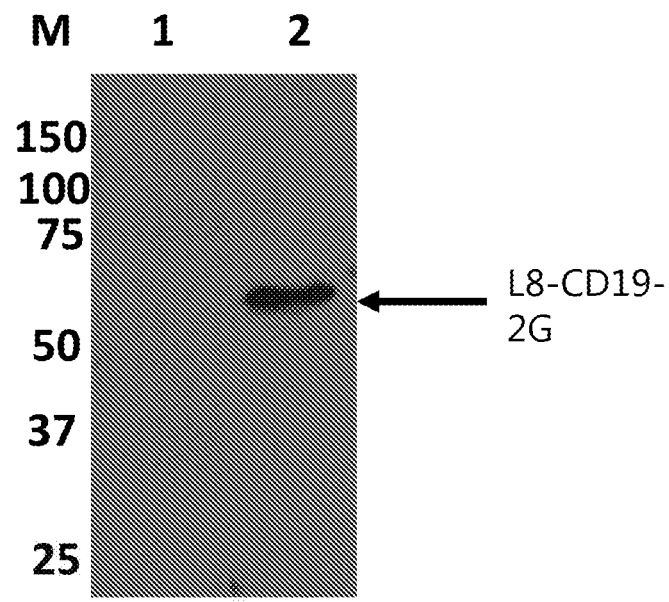
Figure 37C:
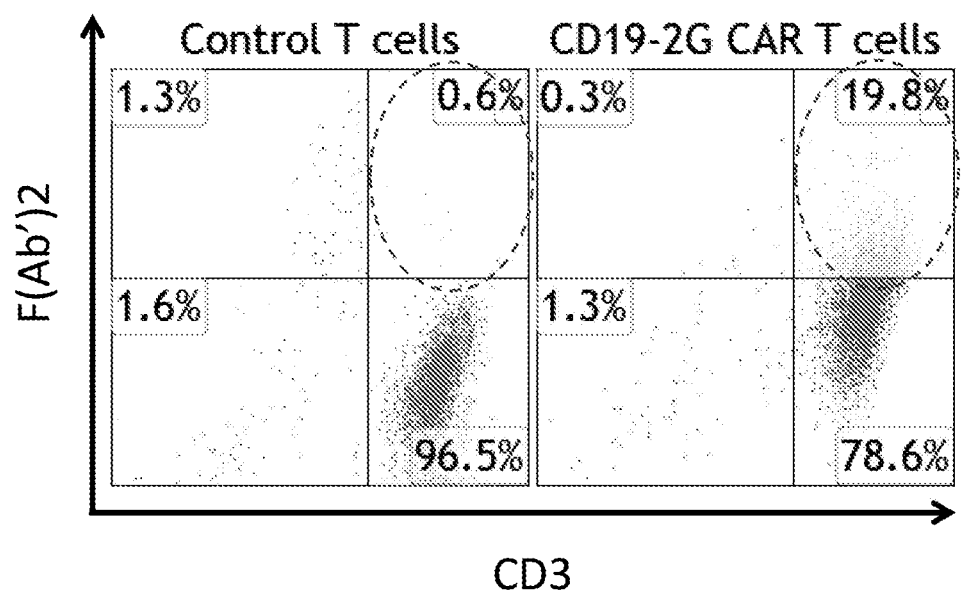

FIGS. 37A-37C. Characterization of CD19 CARs. (37A) Design of CD19CAR unit. (37B) Western blot. HEK-293T cells were transfected with lentiviral plasmids for control vector (lane 1) and CD19-2G (lane 2). 48 hours after transfection, supernatant was removed, and cells were also harvested. Cells were lysed for Western blot and probed with mouse anti-human CD3z primary antibody, and goat anti-mouse HRP secondary antibody. C. PMBC buffy coat T cells were activated 3 days with anti-CD3 antibody. Cells were transduced with either control vector (left), L8-CD19-2G (right) lentiviral supernatant. After 3 days of incubation, cells were harvested and incubated with goat anti-mouse Fab2 or goat IgG antibodies conjugated with biotin for 30 minutes. Cells were washed, suspended and stained with streptavidin-PE and mouse anti-human CD3-PerCp for 30 minutes. Cells were washed and suspended in 2% formalin, and analyzed by flow cytometry to determine CAR efficiency. (N=2)

Figure 38A:
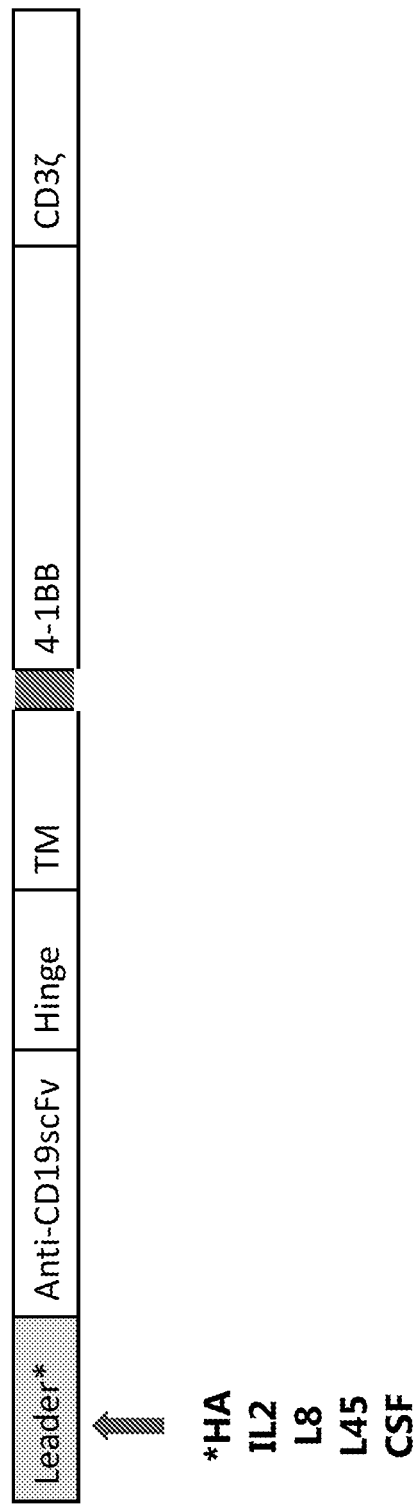
Figure 38B:
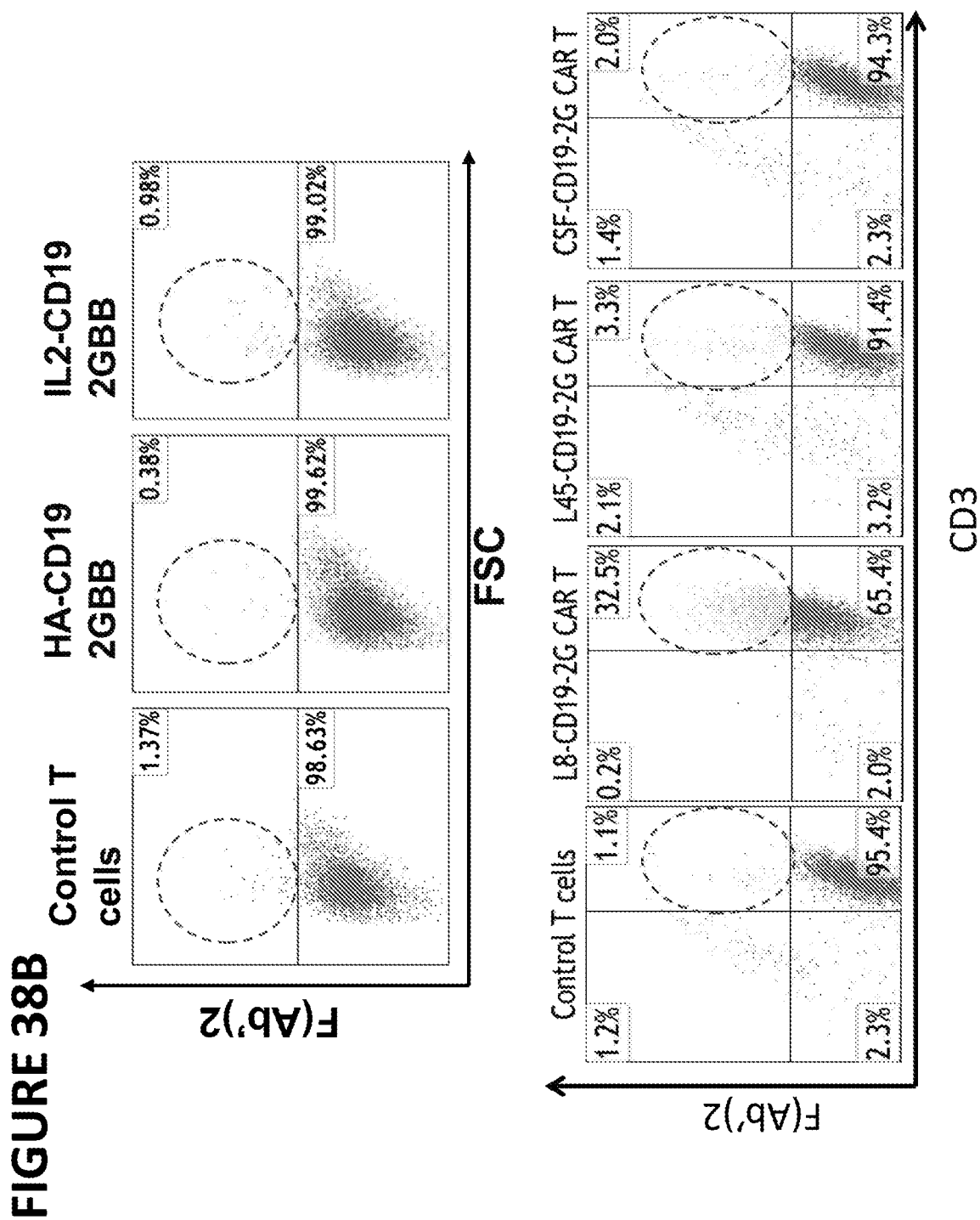

FIGS. 38A-38B. Expression of compound CD19CAR T cells using different leader sequences. (38A) CAR constructs were designed to express the fusion protein with different leader sequences. (38B) PMBC buffy coat T cells were activated 3 days with anti-CD3 antibody. Cells were transduced with either control vector (left), HA-CD19-2G (top middle), IL2-CD19-2G (top right), L8-CD19-2G (lower middle left), L45-CD19-2G, (lower middle right) or CSF-CD19-2GCAR (lower right) lentiviral supernatant. After 3 days of incubation, cells were harvested and incubated with goat anti-mouse Fab2 or goat IgG antibodies conjugated with biotin for 30 minutes. Cells were washed, suspended and stained with streptavidin-PE and mouse anti-human CD3-PerCp for 30 minutes. Cells were washed and suspended in 2% formalin, and analyzed by flow cytometry to determine CAR efficiency. (N=2)

Figures 39A, 39B:
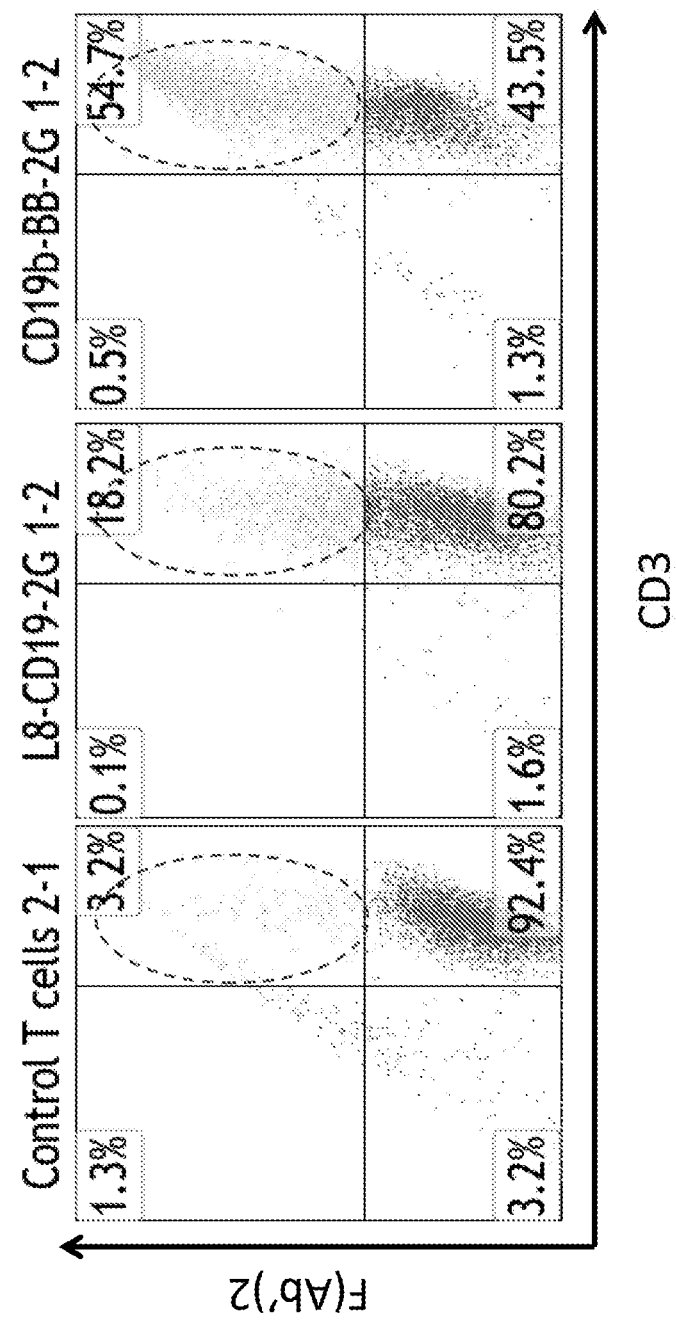

FIGS. 39A-39B. Expression of CD19CAR on T cells using different CD19 scFv sequences. (39A) CAR constructs were designed to express the fusion protein with different scFv sequences. (39B) PMBC buffy coat T cells were activated 3 days with anti-CD3 antibody. Cells were transduced with either control vector (left), L8-CD19-2G (middle), IL2-CD19-2G (top right), or L8-CD19b-BB-2G (right) lentiviral supernatant. After 3 days of incubation, cells were harvested and incubated with goat anti-mouse Fab2 or goat IgG antibodies conjugated with biotin for 30 minutes. Cells were washed, suspended and stained with streptavidin-PE and mouse anti-human CD3-PerCp for 30 minutes. Cells were washed and suspended in 2% formalin, and analyzed by flow cytometry to determine CAR efficiency. (N=2)

Figure 40:
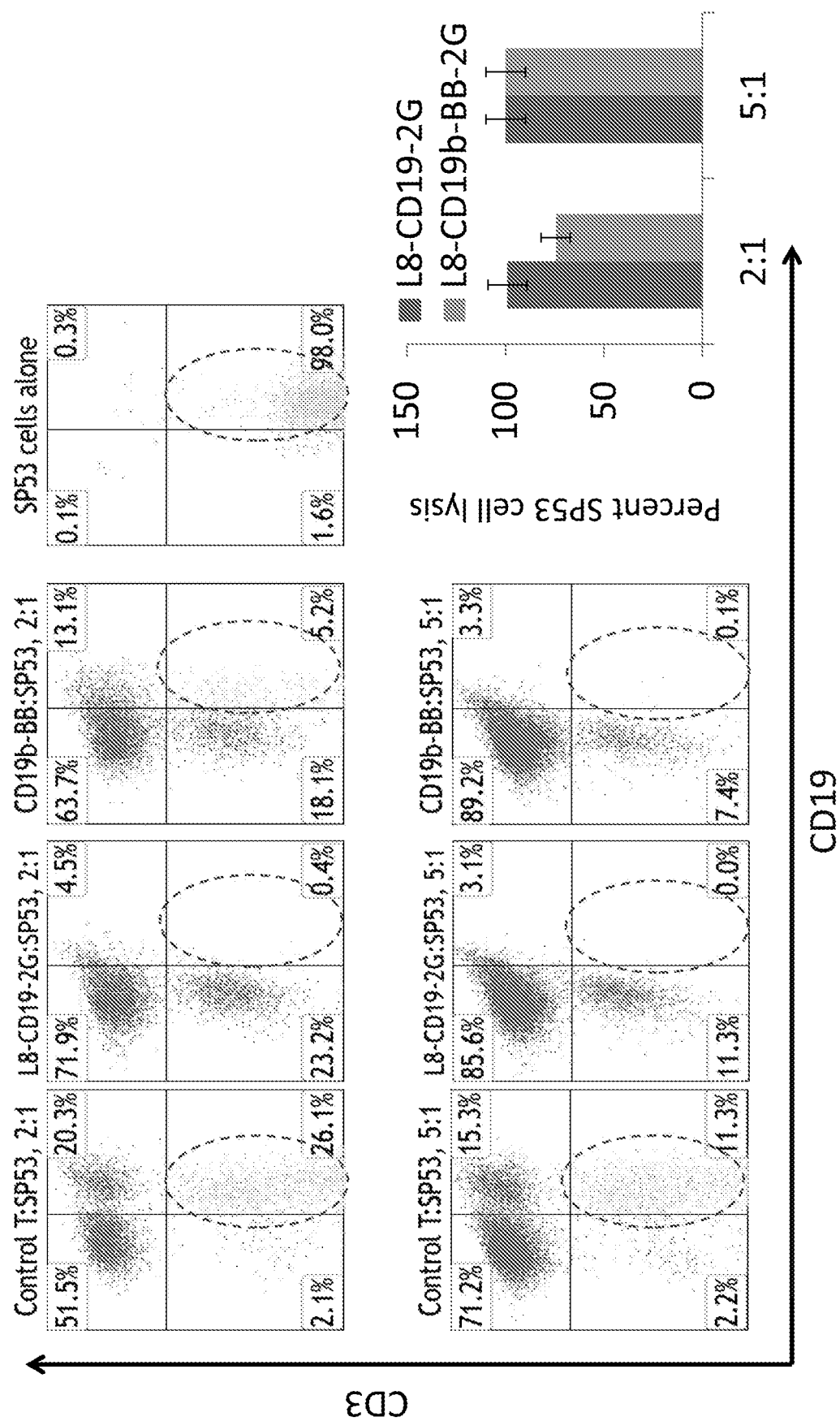

FIG. 40. L8-CD19-2G and CD19b-BB CAR T cells lyse SP53 tumor cells in overnight co-culture. Activated PMBC T cells transduced with either control (left), L8-CD19-2G, (middle) or L8-CD19b-BB-2G (right) lentiviral supernatant were incubated with SP53 cells at the ratios of 2:1 (top) and 5:1 (bottom), effector:target cells. After 24 hours of incubation at 37° C., samples were washed and stained with anti-human CD3-PerCp and anti-human CD19-APC, washed, and analyzed by flow cytometry. SP53 cells alone and a summary of cell lysis are shown on the far right. (N=2)

Figure 41:
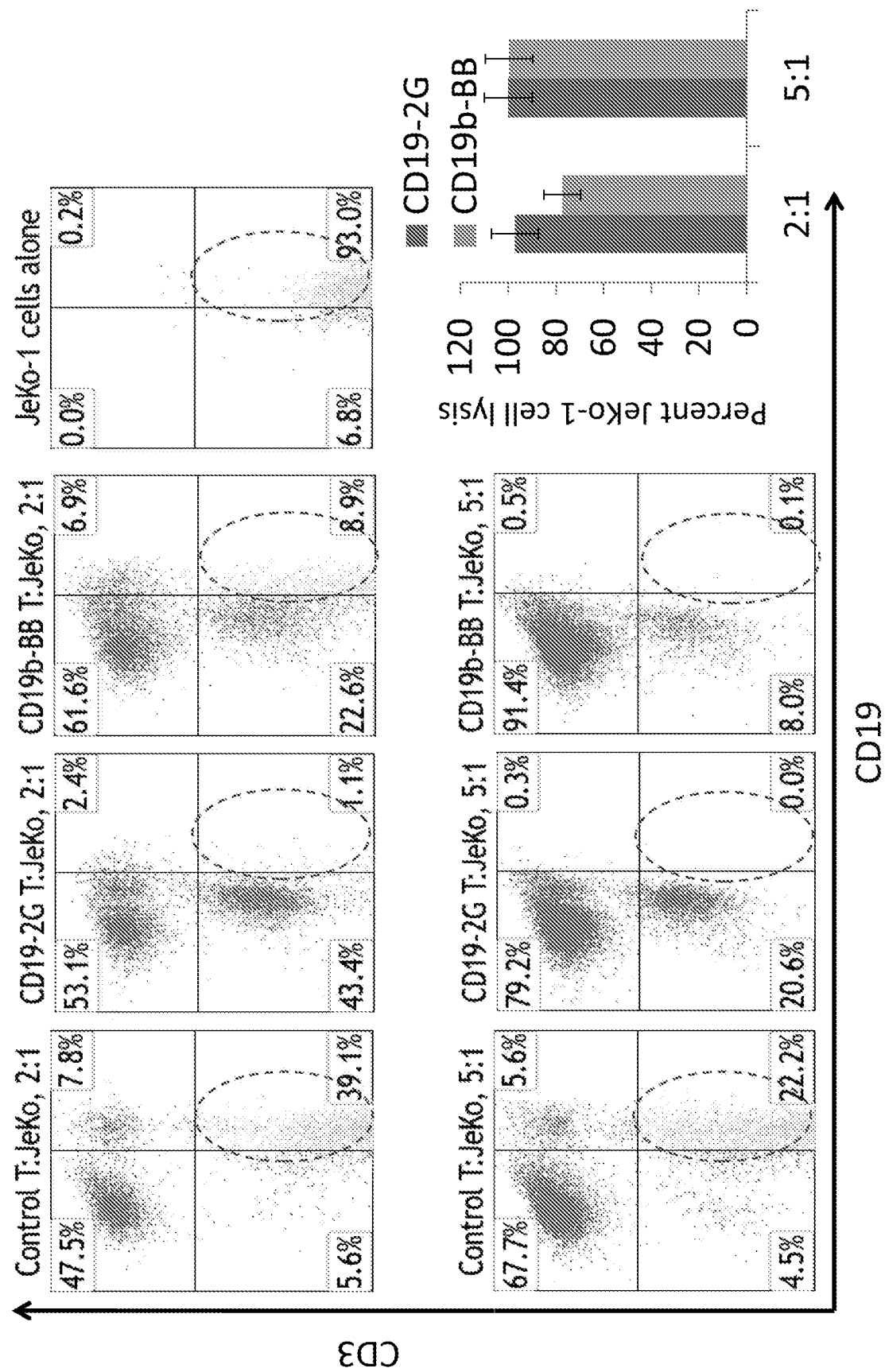

FIG. 41. L8-CD19-2G and CD19b-BB CAR T cells lyse JeKo-1 tumor cells in overnight co-culture. Activated PMBC T cells transduced with either control (left), L8-CD19-2G, (middle) or L8-CD19b-BB-2G (right) lentiviral supernatant were incubated with JeKo-1 cells at the ratios of 2:1 (top) and 5:1 (bottom), effector:target cells. After 24 hours of incubation at 37° C., samples were washed and stained with anti-human CD3-PerCp and anti-human CD19-APC, washed, and analyzed by flow cytometry. JeKo-1 cells alone and a summary of cell lysis are shown on the far right. (N=2).

Figure 42:
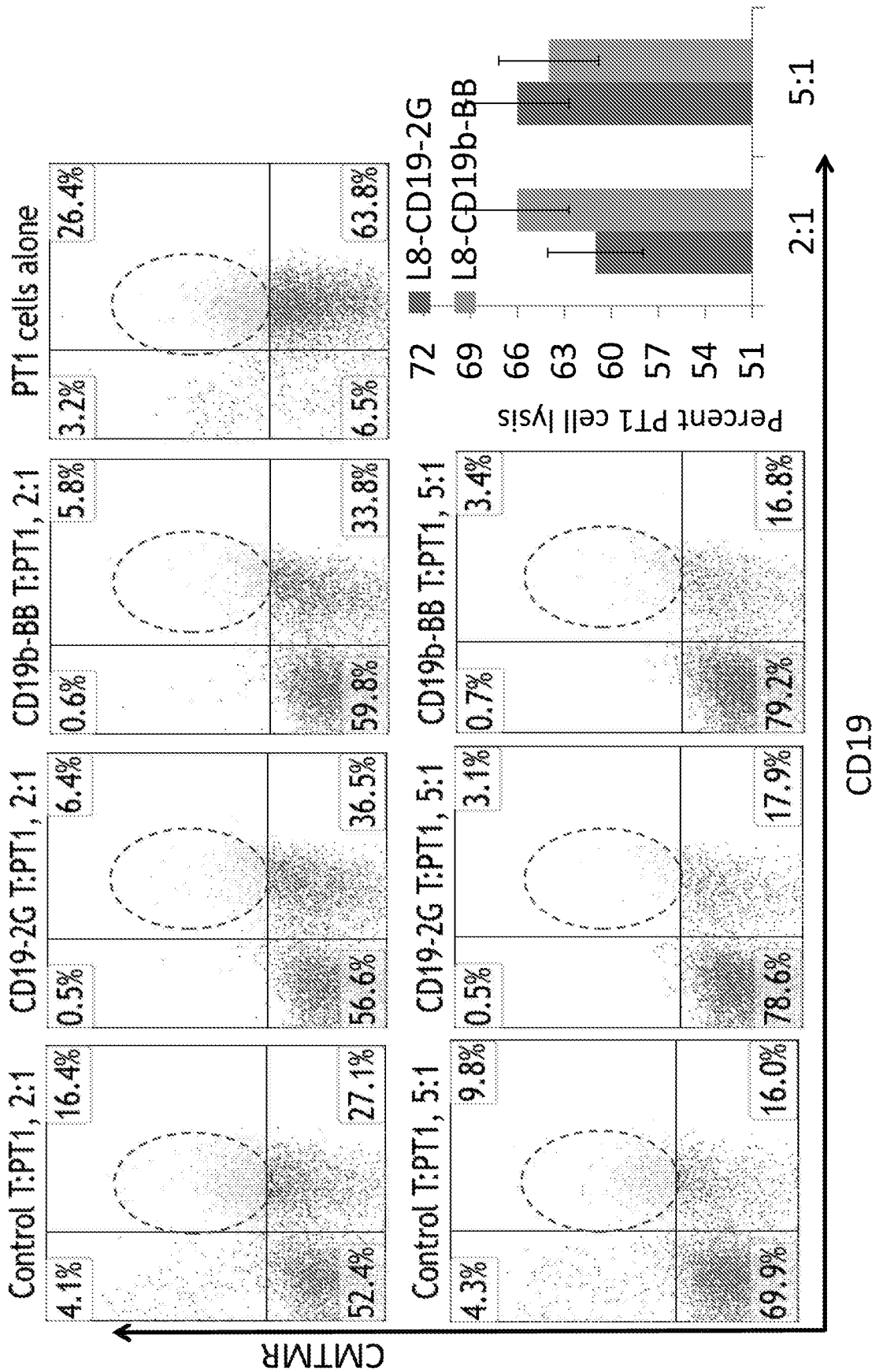

FIG. 42. L8-CD19-2G and L8-CD19b-BB-2G CAR T cells lyse AML patient cells in overnight co-culture. Activated PMBC T cells transduced with either control (left), L8-CD19-2G, (middle) or L8-CD19b-BB-2G (right) lentiviral supernatant were incubated with CMTMR-stained cells from a patient with AML at the ratios of 2:1 (top) and 5:1 (bottom), effector:target cells. After 24 hours of incubation at 37° C., samples were washed and stained with anti-human CD3-PerCp and anti-human CD19-APC, washed, and analyzed by flow cytometry. Prestained patient cells alone and a summary of cell lysis are shown on the far right. (N=2).

Figure 43:
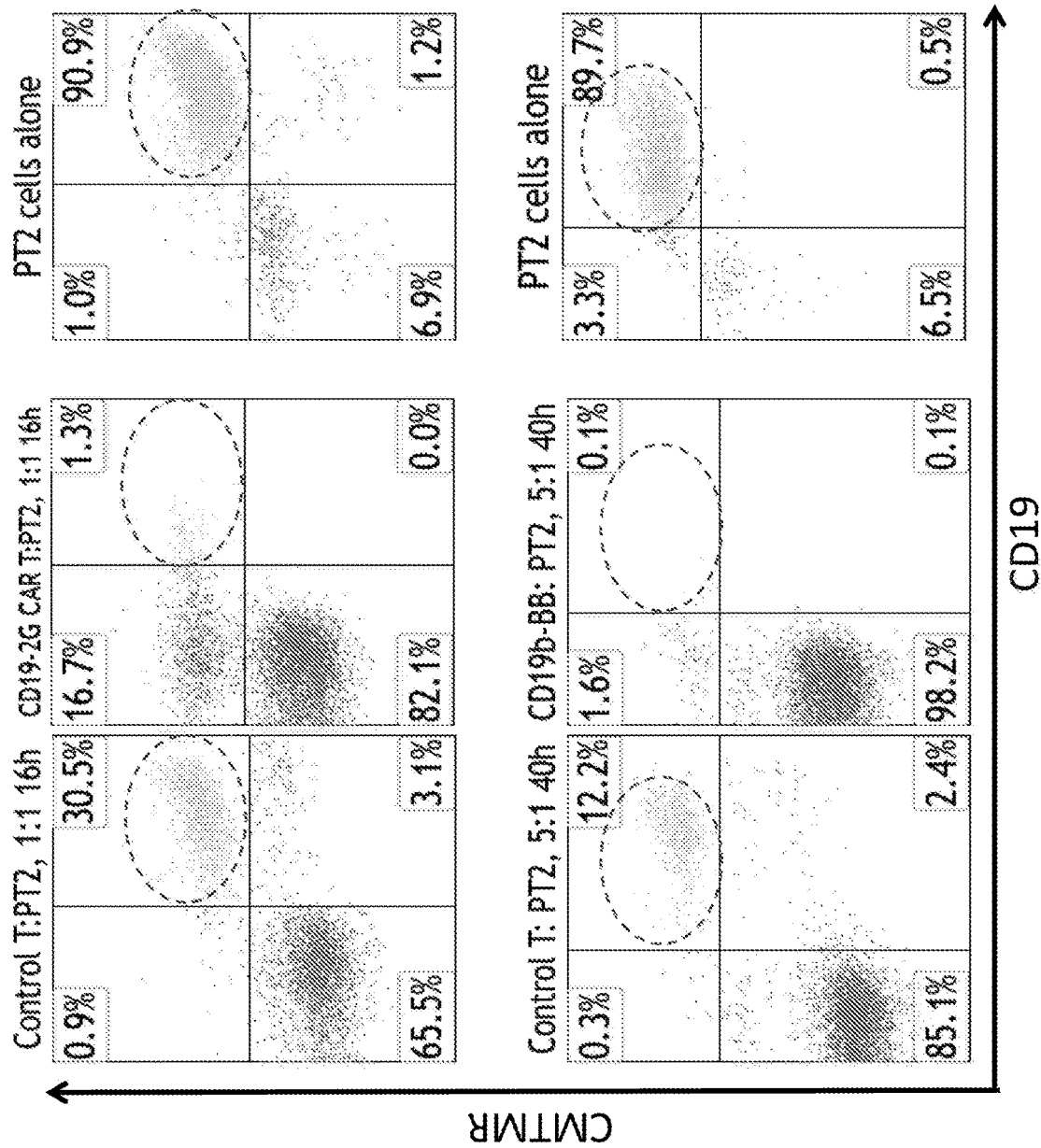

FIG. 43. L8-CD19-2G and L8-CD19b-BB-2G CAR T cells deplete CD19+ patient cells. Activated PMBC T cells transduced with either control (left), L8-CD19-2G, (middle) or L8-CD19b-BB-2G (right) lentiviral supernatant were incubated with CMTMR-stained cells from a patient with B-ALL. L8-CD19-2G T cells were incubated with patient cells at a 1:1 ratio for overnight (top), while L8-CD19b-BB-2G T cells were incubated with patient cells at a 5:1 ratio for 40 hours (bottom). Following this incubation at 37° C., samples were washed and stained with anti-human CD3-PerCp and anti-human CD19-APC, washed, and analyzed by flow cytometry. Prestained patient cells alone are shown on the far right. (N=2).

Figure 44:
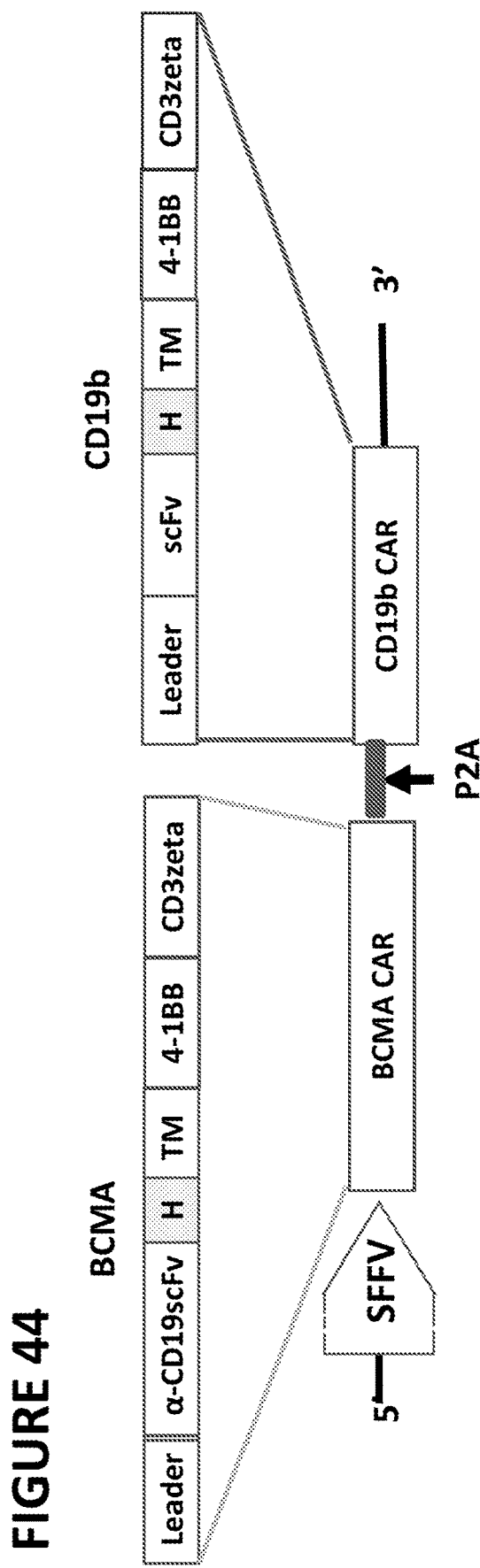

FIG. 44. A schematic showing cCAR construct. The construct consists of a SFFV promoter driving the expression of two modular units of CAR linked by a P2A peptide. Upon cleavage of this P2A peptide, the cCARs split and engage upon targets expressing BCMA and/or CD19b. Two unit CARs use different or same co-stimulatory domain. A co-stimulatory domain could be 4-1BB or CD28.

Figure 45A:
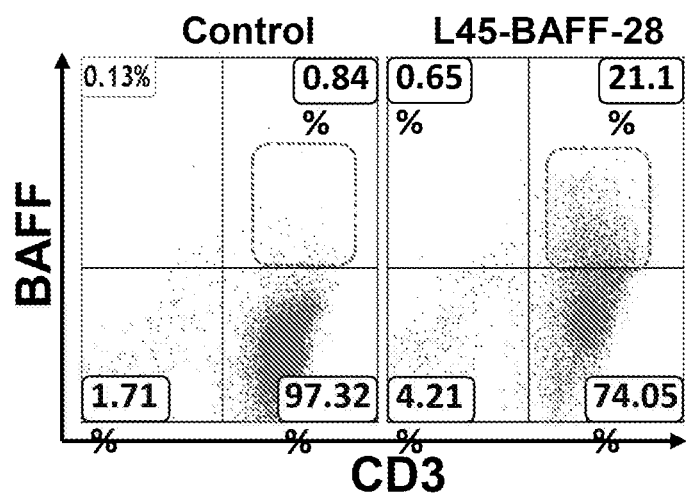
Figure 45B:
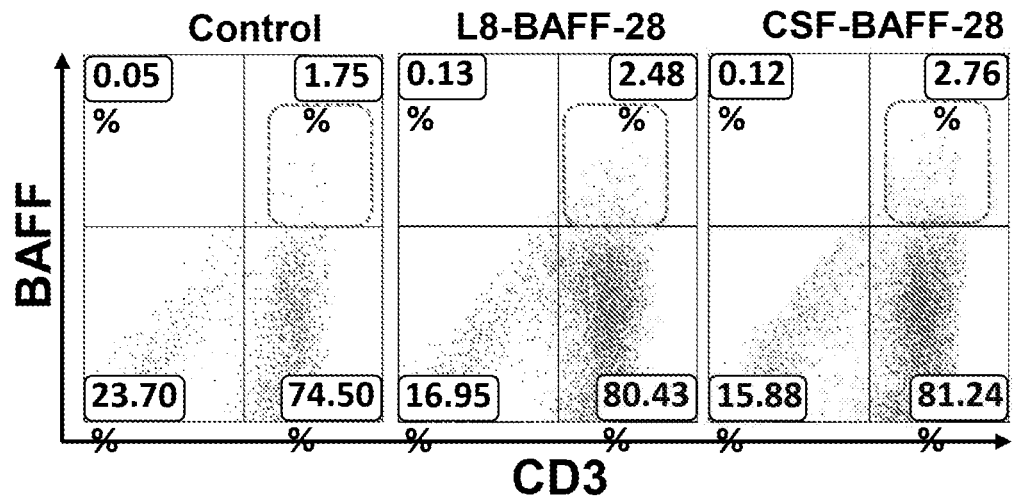
Figure 45C:
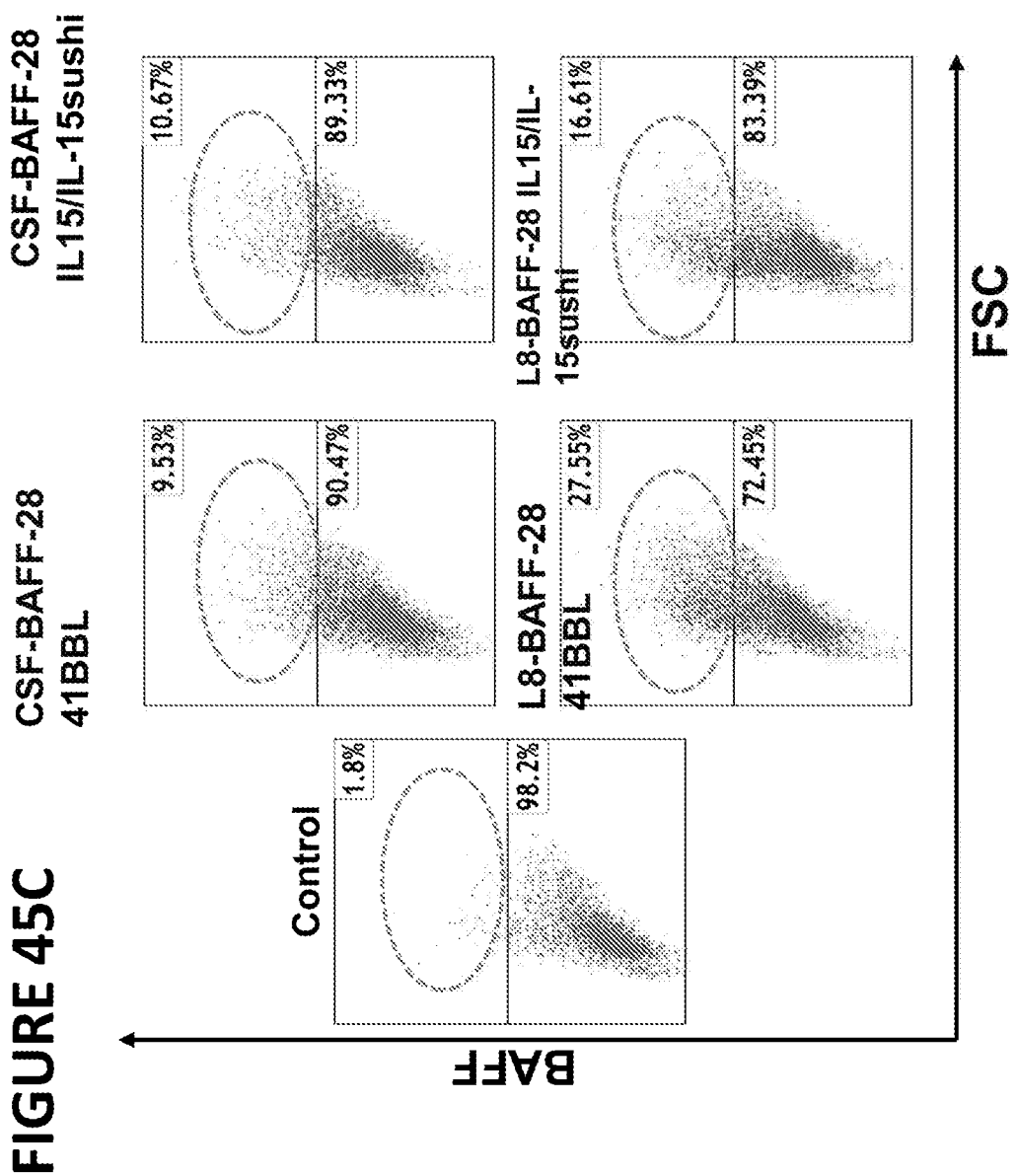

FIGS. 45A-45C. Generation and characterization of different BAFF-CAR constructs. (45A) L45-BAFF-28 CAR was transduced into T-cells and evaluated for surface expression using F(ab)' antibody. Gating was compared to controls. (45B) BAFF-CAR constructs using different leader sequences were tested to determine if efficiency in transduction could be improved. Surface detection was evaluated using F(ab)' antibody and transduced populations encircled. (45C) Additional BAFF-CAR constructs containing different leader sequences and construct designs (additional units) were validated and used to determine if CAR transduction could be improved. Transduced populations are encircled and gating compared to control T-cells. CSF-BAFF-28 41BBL is a BAFF CAR co-expressing 4-1BBL (41BBL) with a CSF leader sequence. CSF-BAFF-28IL-15/IL-15sushi—is a BAFF CAR co-expressing IL-15/IL-15sushi with a CSF leader.

Figure 46A:
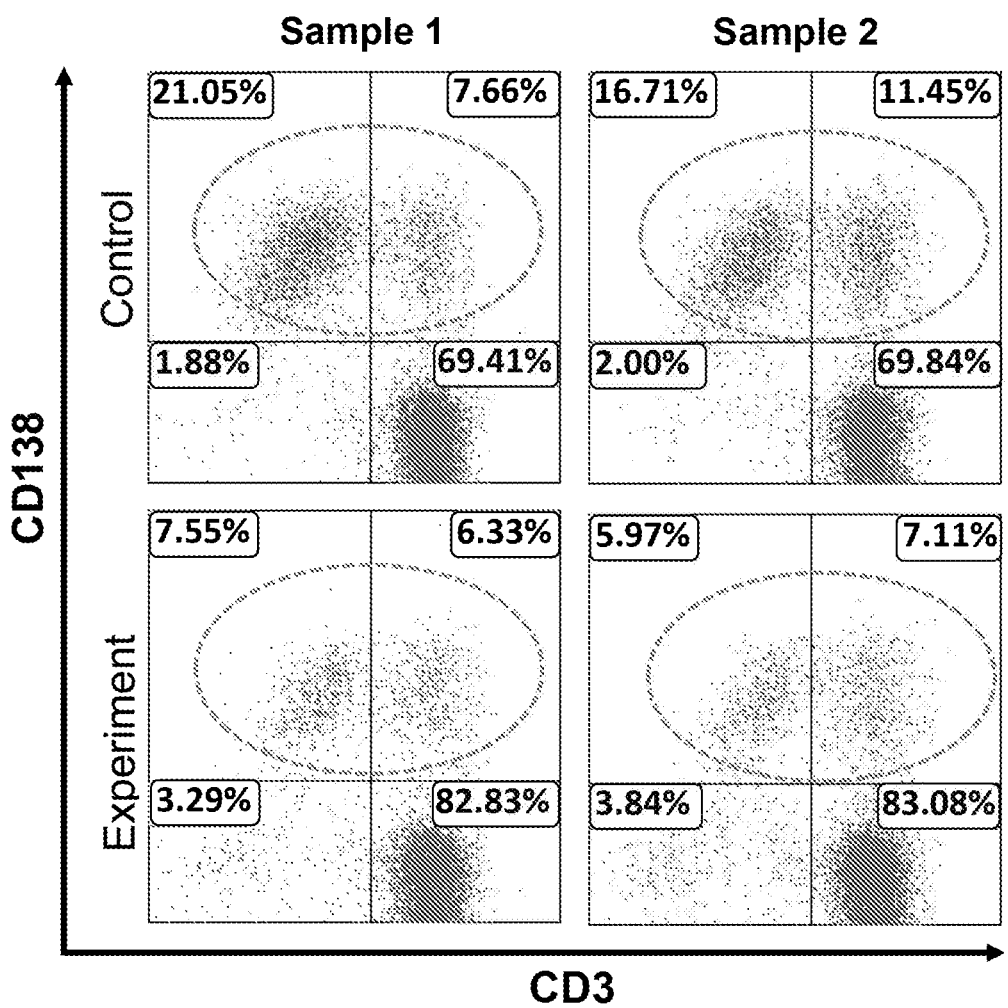
Figure 46B:
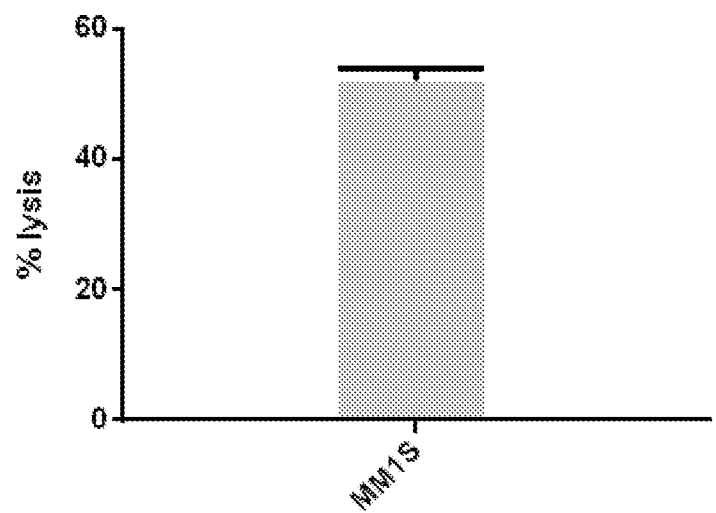

FIGS. 46A-46B: L45-BAFF-28 CAR T-cells possess anti-tumor activity against MM1S tumor cells. Characterization of L45-BAFF-28 CAR T anti-tumor properties. (46A) BAFF CAR cytotoxic activity in vitro summarized from (46B). (46B) L45-BAFF-28 CAR T-cells possess anti-tumor activity against MM1S tumor cells. L45-BAFF-28 CAR T-cells were cultured for 48 hours at an E:T ratio of 3:1 against MM1S myeloma cells. Duplicate samples are shown.

Figure 47A:
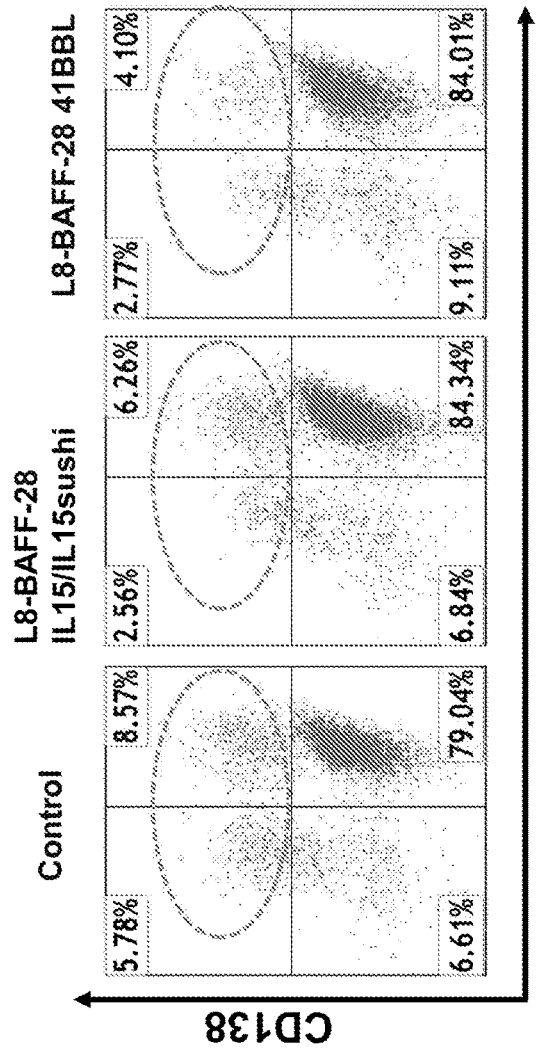
Figure 47B:
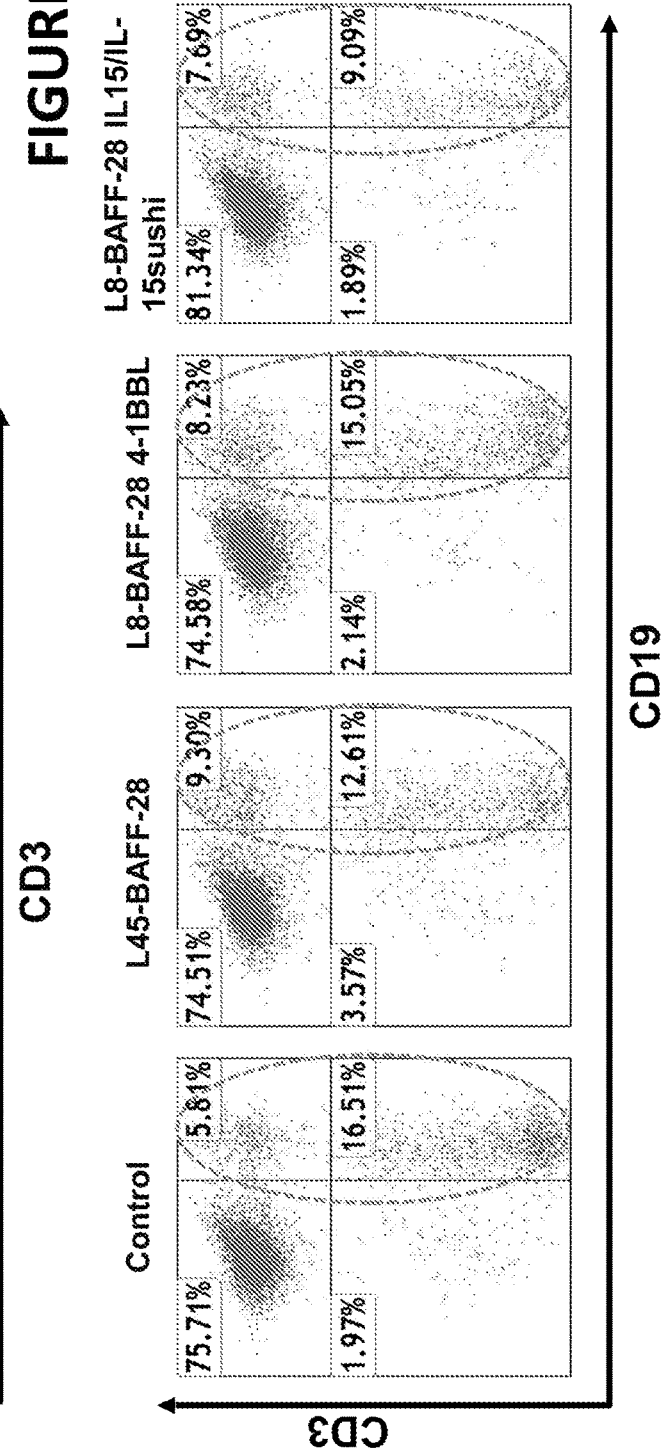

FIGS. 47A-47B Characterization of anti-tumor activity using different BAFF-CAR constructs and enhancements. (47A) L8-BAFF-28IL-15/IL-15sushi and L8-BAFF-28 4-1BBL CARs were cultured for 24 hours against MM1S tumor cells at an E:T ratio of 5:1. Tumor populations are encircled. (47B) Both CARs and L45-BAFF-28 CAR were cultured against Sp53 tumor cells (B-lineage) at an E:T ratio of 5:1 for 24 hours.

Figure 48:
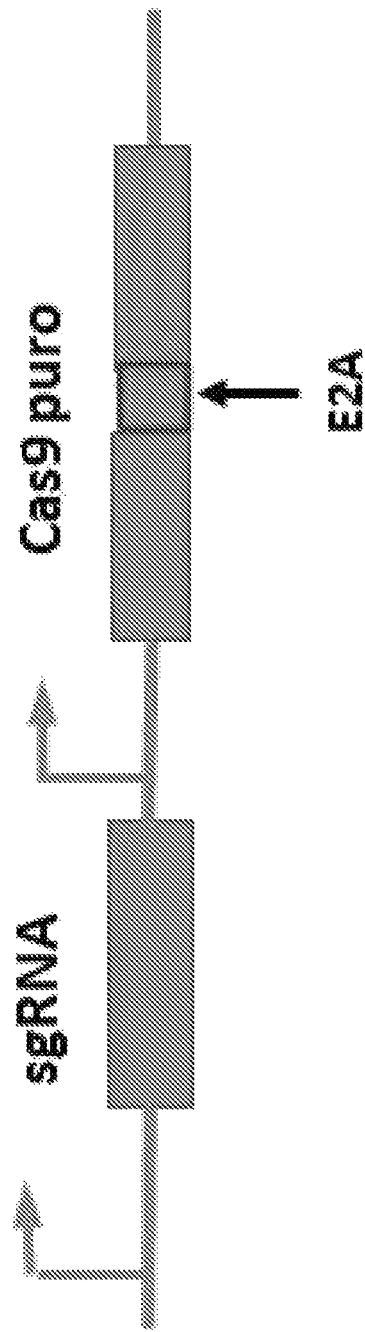

FIG. 48. CRISPR/Cas9 interference system. The expression of sgRNA and Cas9 puromycin is driven by the U6 and SFFV promoters, respectively. The Cas9 is linked with puromycin resistant gene by E2A self-cleaving sequences.

FIG. 49A. Steps of generation of CAR T or NK cell targeting hematologic malignancies.

Figure 49B:
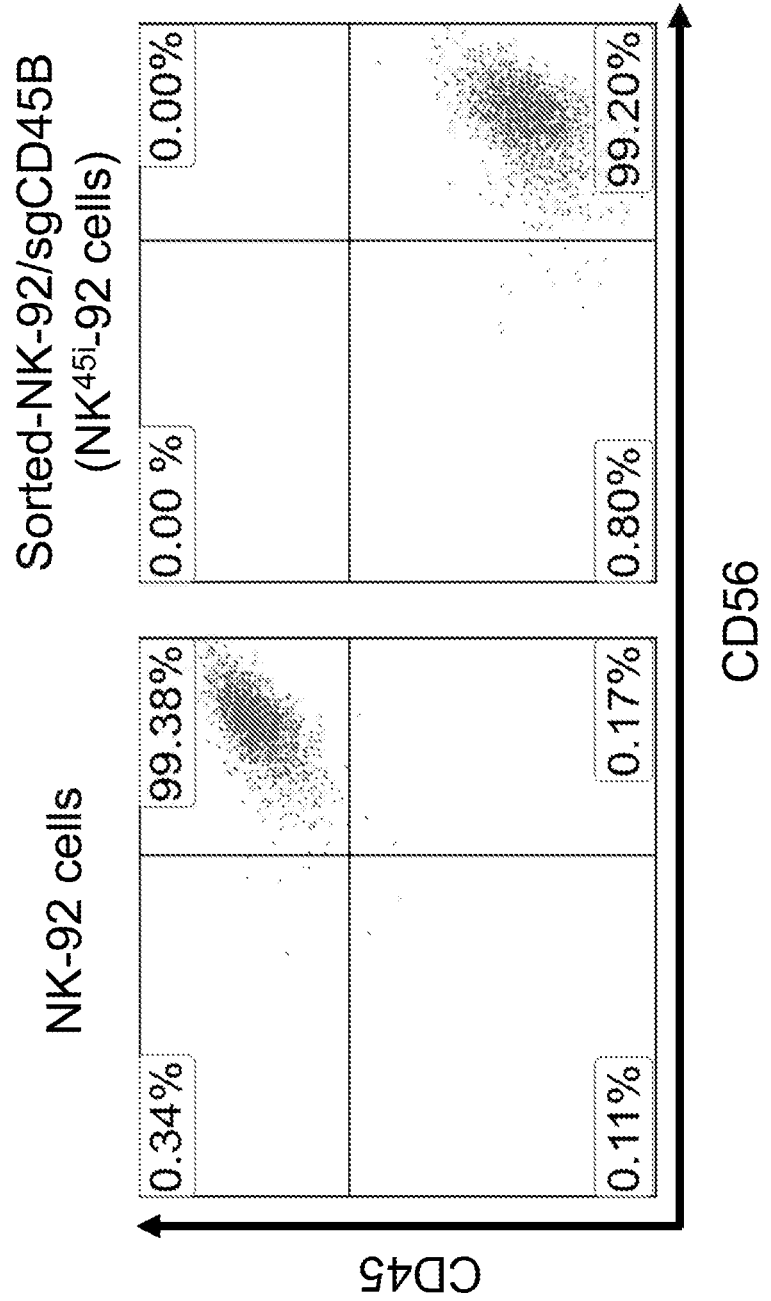

FIG. 49B. Generation and cell sorting of stable CD45 knockdown NK-92 cells using CRISPR/Cas9 lentivirus system. Flow cytometry analysis indicated the CD45 expression levels on NK-92 cell surface (left panels). After transduced sgCD45B CRISPR into NK-92 cells, transduced cells were cultured in medium containing puromycin for a few weeks. CD45 negative NK-92 cells were determined using CD45 antibody and were sorted. The purity of stable $NK^{45i}$-92 (CD45 knockdown) NK-92 cells was determined by Flow cytometry analysis (right panel). This data showed that we successfully generated and obtained $NK^{45i}$-92 cells.

Figure 50:
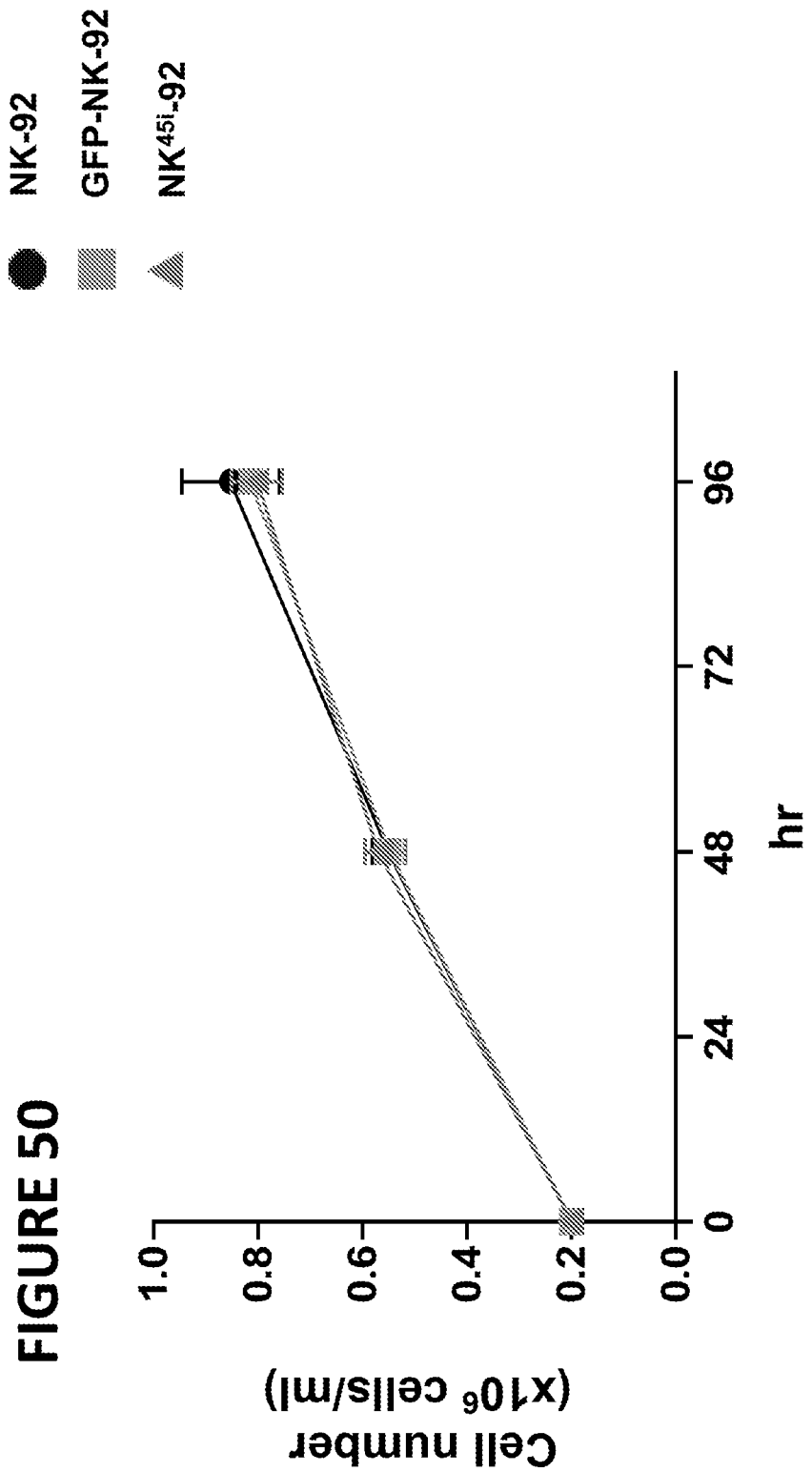

FIG. 50. Cell growth curve of wild type, GFP transduced NK-92 or $NK^{45i}$-92NK cells. To evaluate the effect for cell proliferation caused by CD45-knockdown (KD) in NK-92 cells, the number of cells of NK-92(●), GFP-transduced NK-92(■) and $NK^{45i}$-92(▲) were counted at 48 h and 96 h after seeding into 24 well plates. IL-2 was added at 48 h time point. (n=3 independent experiments performed in duplicate). Data are mean±S.D. These data indicated that knockdown of CD45 receptor on NK-92 show similar cell growth curve compared to non-transduced NK-92 or GFP-transduced NK-92 cells. 24 well, duplicate, n=3 IL-2 was added at 48 hr time point.

FIGS. 51A-51B. Co-culture assay with CCRF-CEM (target: T) and GFP NK-92 or GFP $NK^{45i}$-92 cells (effector: E) at 5:1 (E:T) ratio and 16 hour incubation. (51A) Flow cytometry analysis of CCRF-CEM only (blue dot in left panel), in co-culture with CCRF-CEM and control GFP transduced NK-92 cells (middle panel) or GFP $NK^{45i}$-92 cells (right panel). Blue dots in all of panels indicate the leftover target CCRF-CEM cells and red dots show effector cells by co-culture assay. The majority of the blue dots are in the upper left square of each experiment. The incubation time was 6 h and the ratio of effector T-cells:target cell was 5:1. All experiments were performed in duplicate. (51B) Bar graph indicates the percent of cell lysis by the GFP transduced $NK^{45i}$-92 cells compared to the control GFP transduced NK92 cells in co-culture assay with CCRF-CEM. These data suggest that knockdown of CD45 in NK-92 cells does not show a significant difference for killing activity against CCRF-CEM cells compared to GFP-control NK-92 cells in vitro co-culture assay.

Figure 52A:
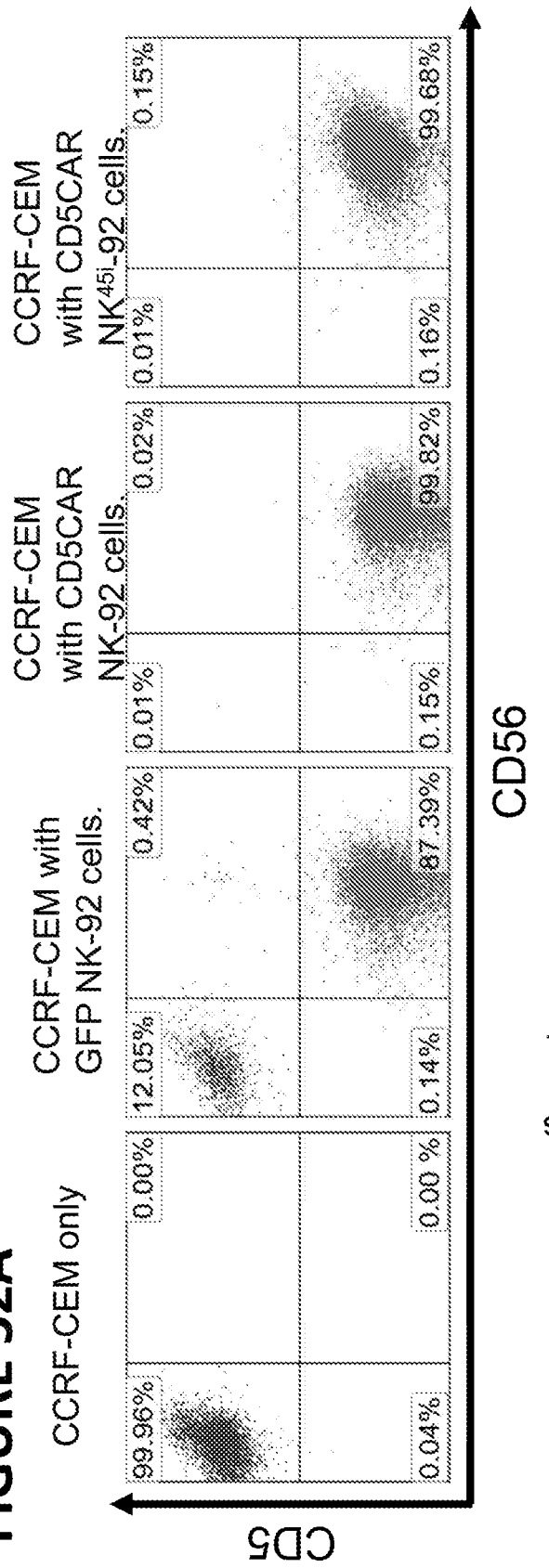
Figure 52B:
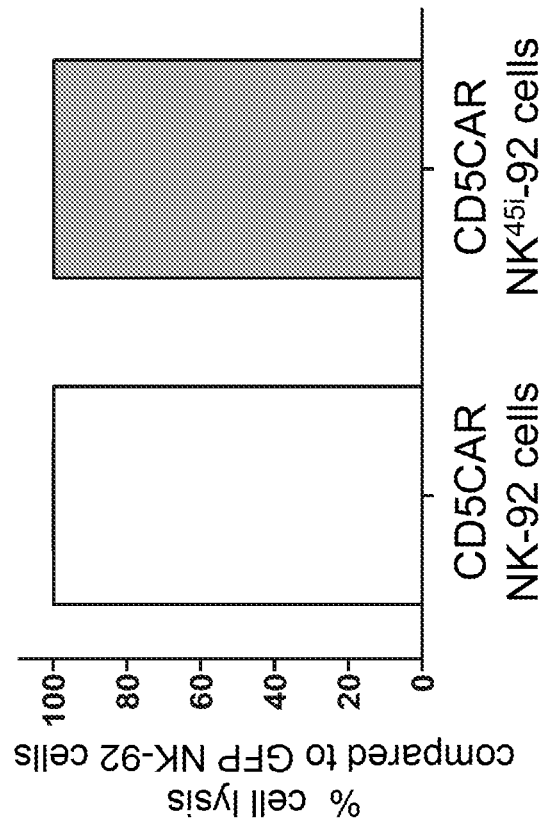

FIGS. 52A-52B. Co-culture assay with CCRF-CEM (target: T) and GFP NK-92, CD5CAR NK-92 or CD5CAR $NK^{45i}$-92 cells (effector: E) at 5:1 (E:T) ratio and 16 hour incubation. (52A) Flow cytometry analysis of CCRF-CEM only (left panel), in co-culture with CCRF-CEM and control GFP NK-92 cells (middle left panel), CD5CAR NK-92 cells (middle right panel), CD5CAR NK$^{45i}$-92 cells (right panel) from right to left. Blue dots in all of panels indicate the leftover target CCRF-CEM cells and red dots show effector cells by co-culture assay. The incubation time was 16 h and the ratio of effector T-cells:target cell was 5:1. All experiments were performed in duplicate. (52B) Bar graph indicates the percent of cell lysis by the CD5CAR NK-92 cells or CD5CAR NK$^{45i}$-92 cells compared to the control GFP NK92 cells in co-culture assay with CCRF-CEM. Data are mean±S.D. Both of CD5CAR NK-cells and CD5CAR NK$^{45i}$-92 cells shows near to 100% cell killing activity against CD5-positive CCRF-CEM compared to control GFP NK-92 cells. These data suggest that CD5CAR NK-cells and CD5CAR NK$^{45i}$-92 cells can effectively lyse CCRF-CEM cells that express CD5 compared to GFP-control NK-92 cells in vitro co-culture assay and proof that knockdown of CD45 does not affect cell function for killing activity in NK-92 cells.

Figure 53B:
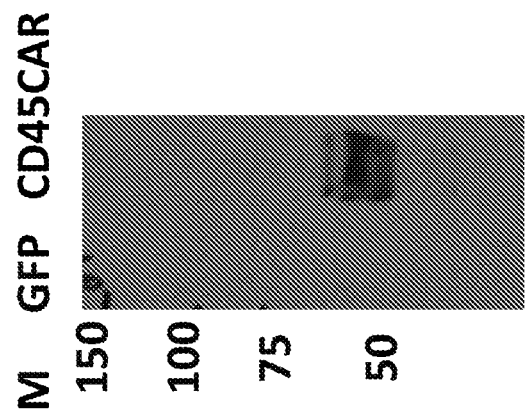
Figure 53A:
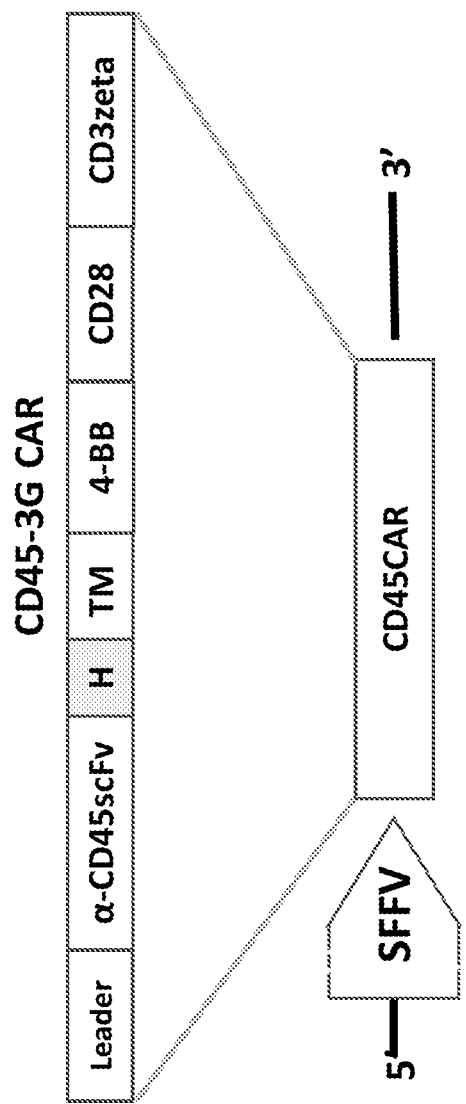

FIGS. 53A-53B. Organization of the CD45CAR construct and its expression. (53A) Schematic representation of the CD45CAR lentiviral vector. The CD45CAR construct is a modularized signaling domain containing: a leader sequence, an anti-CD45scFv, a hinge domain (H), a transmembrane domain (TM), two co-stimulatory domains (CD28 and 4-1BB) that define the construct as a $3^{rd}$ generation CAR, and the intracellular signaling domain CD3 zeta. (53B), HEK-293FT cells were transfected with lentiviral plasmids for GFP (lane 1) and CD45CAR (lane 2). 48 hours after transfection, supernatant was removed, and cells were also removed. Cells were lysed for Western blot and probe with mouse anti-human CD3z antibody.

Figure 54:
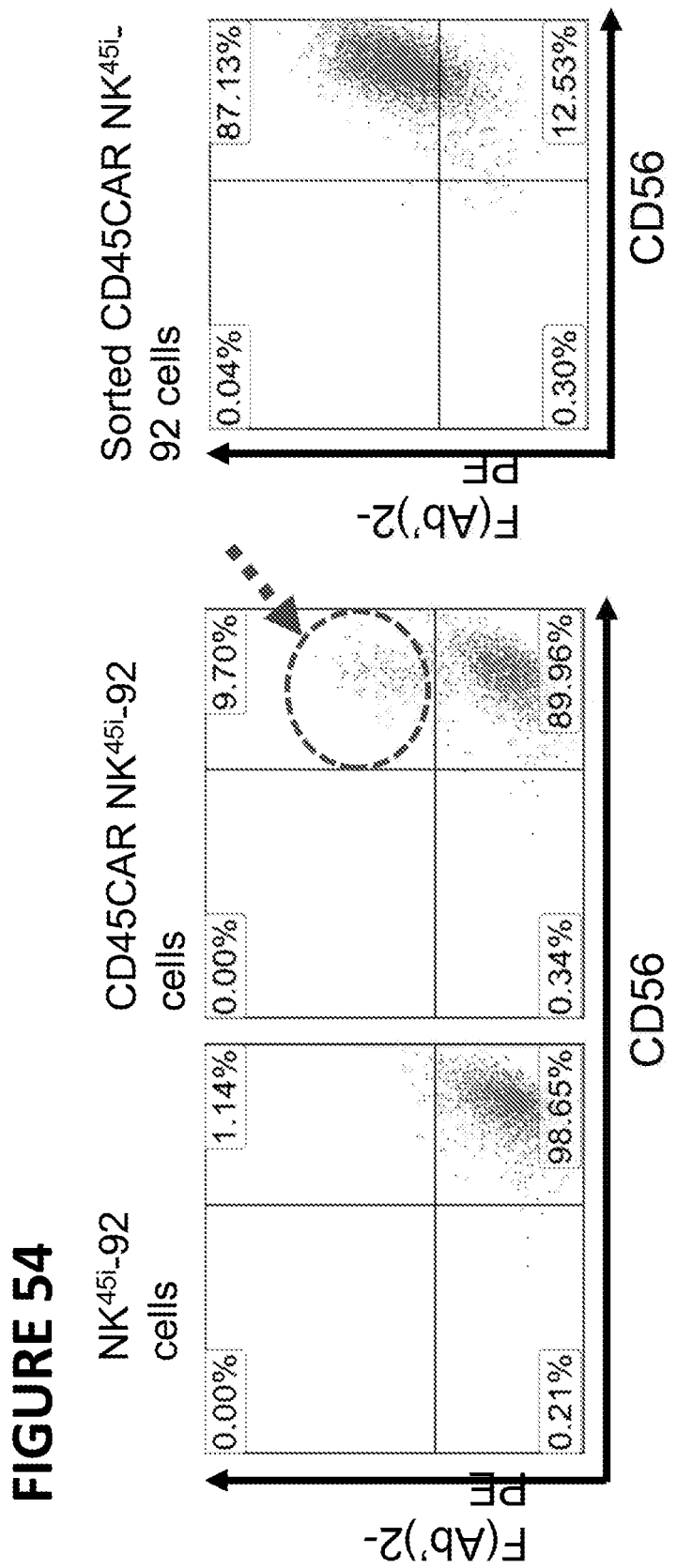

FIG. 54. Transduction of CD45CAR into NK$^{45i}$-92 cells and cell sorting of CD45CAR transduced cells. The expression levels of CD45CAR on NK$^{45i}$-92 were determined by flow cytometry analysis (circled in blue at middle panel) compared to NK$^{45i}$-92 cells (left panel) after CD45CAR lentiviruses were transduced into NK$^{45i}$-92 cells. CD45CAR expressed NK$^{45i}$-92 cells were sorted and CD45 expression levels on cell surface were determined by Flow cytometry analysis (right panel). About 87% of CD45CAR expression on cell surface was detected by flow cytometry analysis.

Figure 55B:
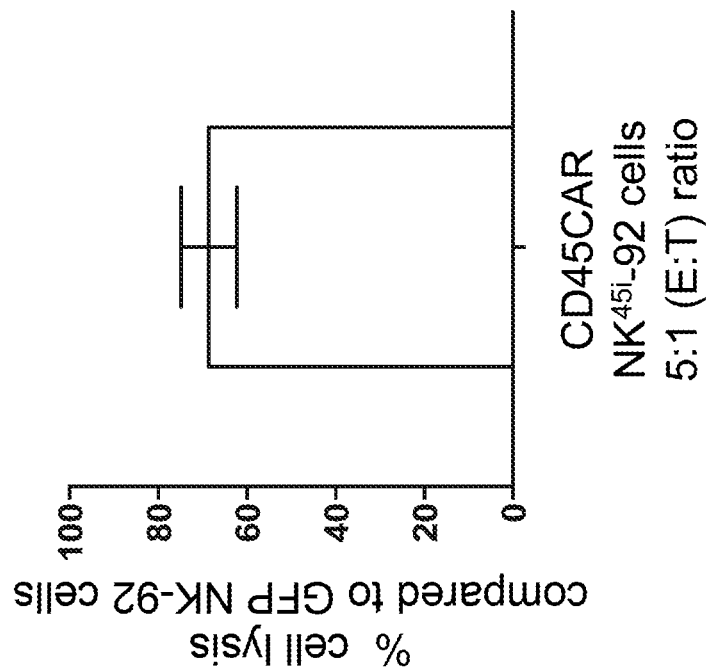
Figure 55A:
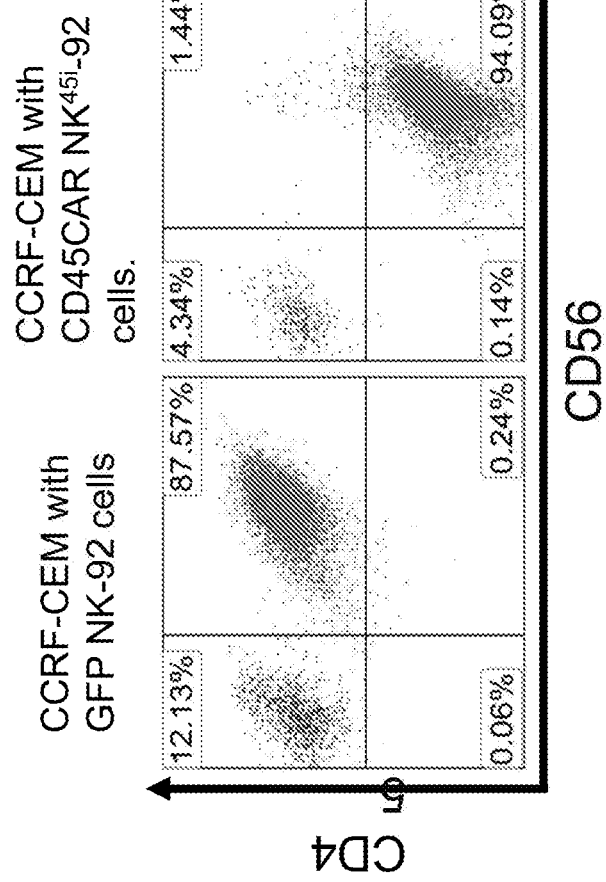

FIGS. 55A-55B. Co-culture assay with CCRF-CEM (target: T) and GFP NK-92 or CD45CAR NK$^{45i}$-92 cells (effector: E) at 5:1 (E:T) ratio and 16 hour incubation. (55A) Flow cytometry analysis of in co-culture with CCRF-CEM and control GFP transduced NK-92 cells (left panel) or CD45CAR NK$^{45i}$-92 cells (right panel). Blue dots in all of panels indicate the leftover target CCRF-CEM cells and red dots show effector NK-92 cells by co-culture assay. The incubation time was 16 h and the ratio of effector T-cells:target cell was 5:1. All experiments were performed in duplicate. (55B) Bar graph indicates the percent of cell lysis by CD45CAR NK$^{45i}$-92 cells compared to the control GFP NK92 cells in co-culture assay with CCRF-CEM. Data are mean±S.D. CD45CAR NK$^{45i}$-92 cells shows about 70% cell lysis against CCRF-CEM cells compared to control GFP NK-92 cells. These data suggest that CD45CAR NK$^{45i}$-92 cells effectively lyse CCRF-CEM cells that express CD45 compared to GFP-control NK-92 cells in vitro co-culture assay.

Figure 56A:
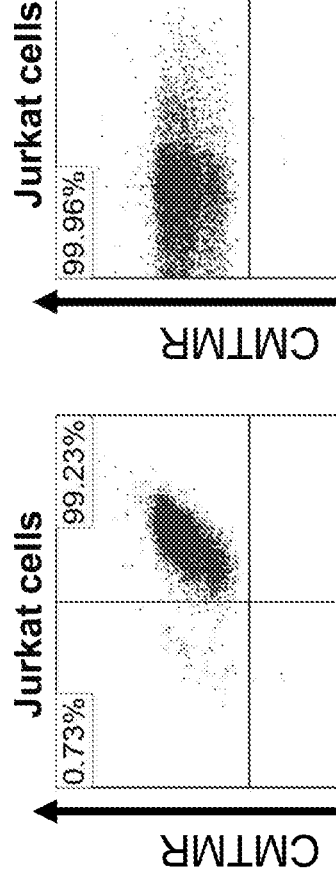
Figure 56B:
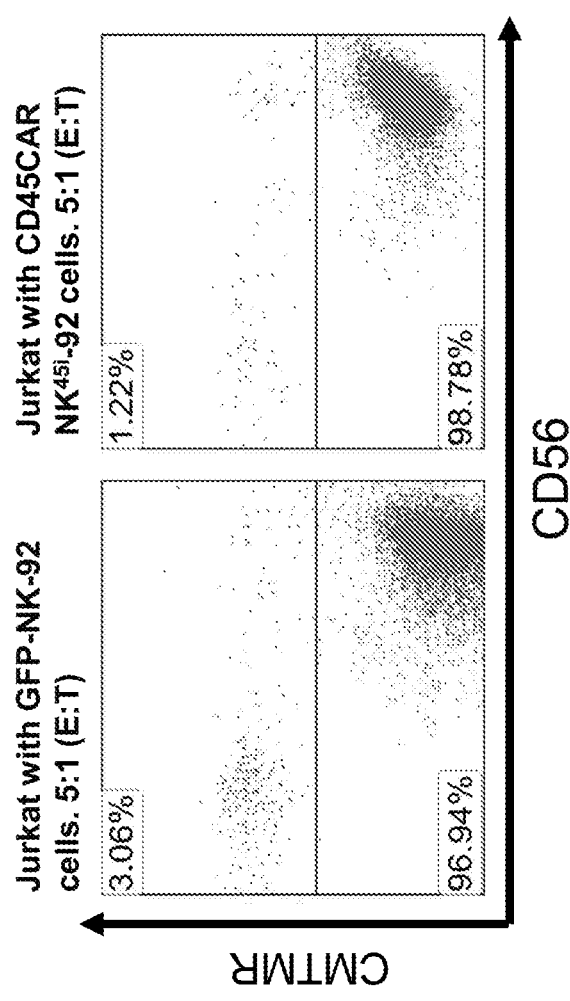
Figure 56C:
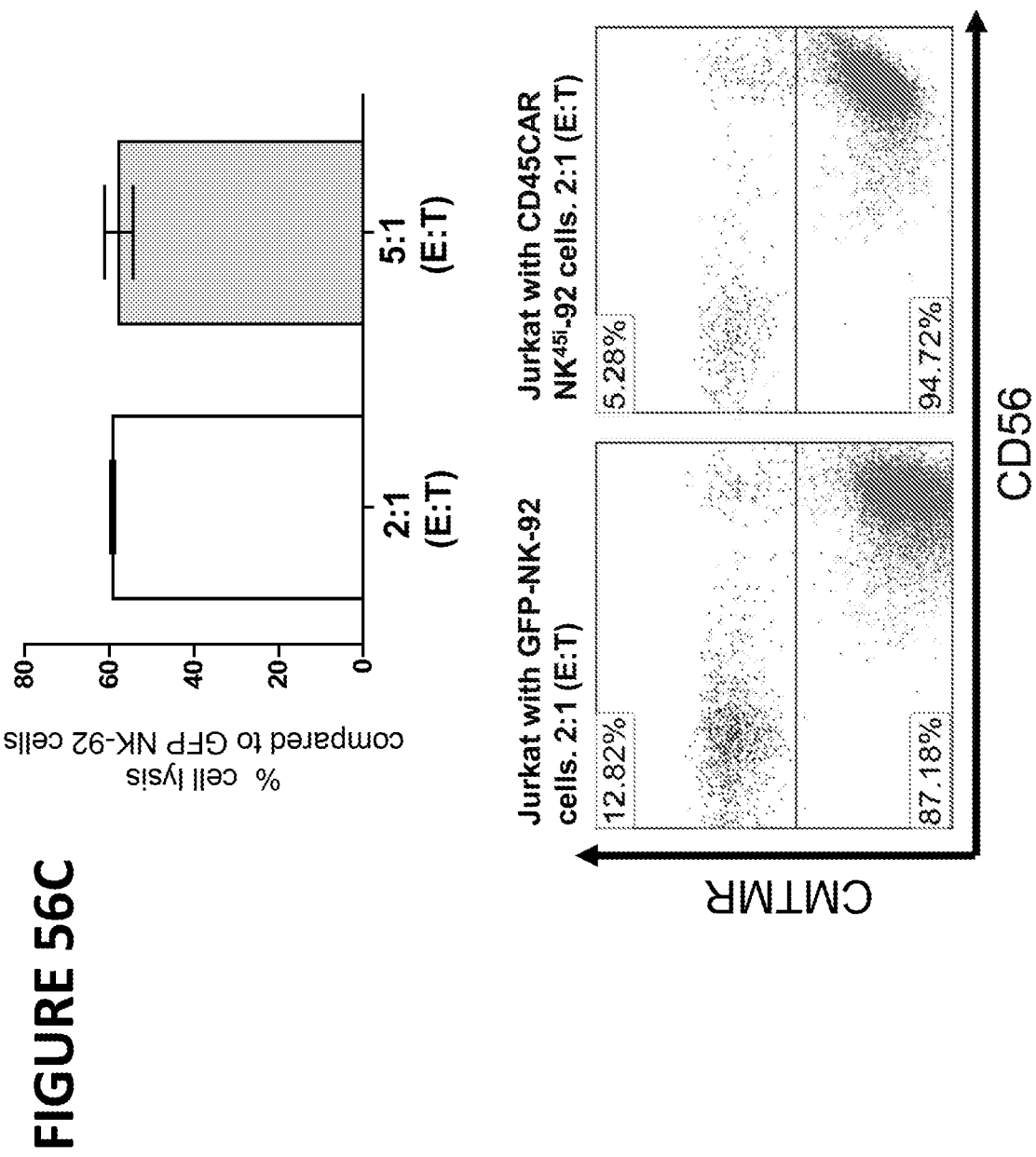

FIGS. 56A-56C. Co-culture assay with Jurkat cells (target: T) and GFP-control or CD45CAR NK$^{45i}$-92 cells (effector: E) at 5:1 or 2:1 (E:T) ratio and 6 hour incubation. (56A) Flow cytometry analysis was carried out after Jurkat cells were stained by CMTMR cell tracker dye. These data show that Jurkat cells are CD45 positive (left panels) and mostly CD56 negative cells (right panel). (56B and 56C) Flow cytometry analysis of co-culture assay with Jurkat cells (target: T) and control or CD45CAR NK$^{45i}$-92 cells (effector: E). The ratio of co-culture assay was performed in 5:1 (56B) or 2:1 (56C)(E: T). Left panels showed that in co-culture with control GFP or CD45CAR/CD45KD NK-92 cells in 5:1 (E:T) ratio and right panels indicated that in co-culture with control GFP or CD45CAR NK$^{45i}$-92 cells in 2:1 (E:T) ratio. Blue dots in panels indicate the leftover target Jurkat cells and red dots represent effector cells by co-culture assay. The incubation time was 6 h. All experiments were performed in duplicate. (56C) Bar graph shows percent cell lysis by CD45CAR NK$^{45i}$-92 cells compared to control GFP NK92 cells at in 5:1 or 2:1 (E: T) ratio. Data are mean±S.D. CD45CAR NK$^{45i}$-92 cells shows about 60% cell lysis against Jurkat cells compared to control GFP NK-92 cells in both conditions. This data suggests that CD45CAR NK$^{45i}$-92 cells effectively lyse Jurkat cells that express CD45 on cell surface compared to GFP-control NK-92 cells in vitro co-culture assay.

Figure 57A:
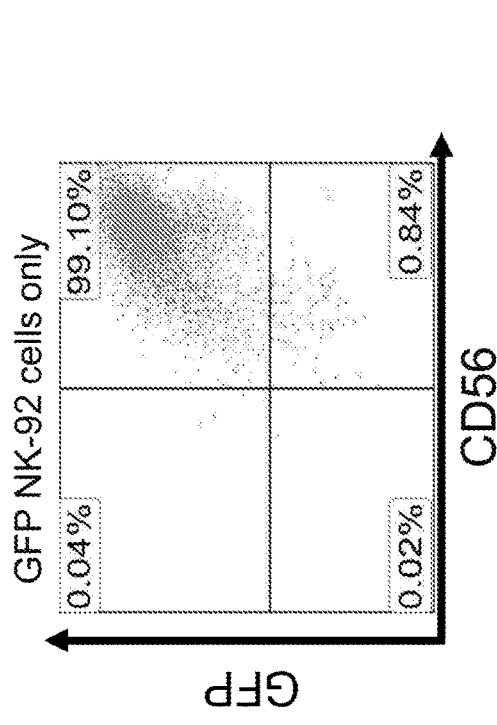
Figure 57B:
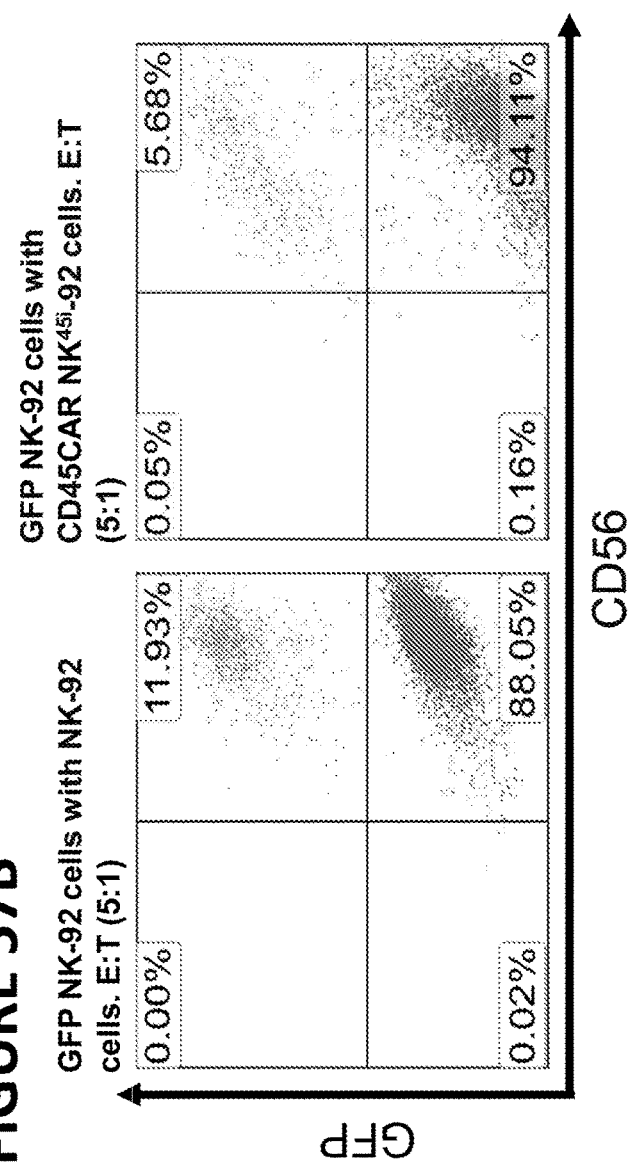
Figure 57C:
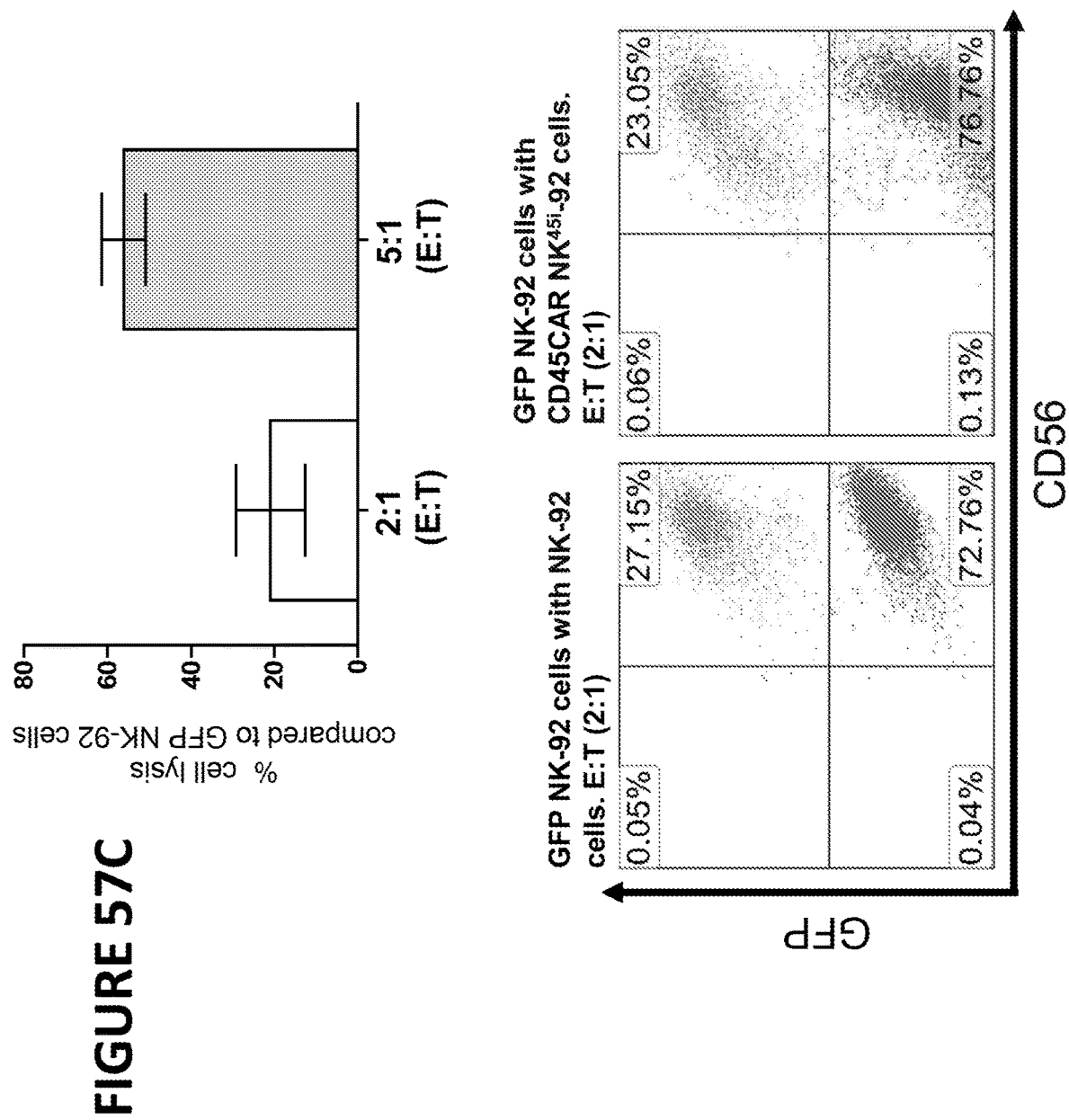

FIG. 57A-57C. Co-culture assay with GFP-NK-92 cells (target: T) and non-transduced NK-92 cells or CD45CAR NK$^{45i}$-92 cells (effector: E) at 5:1 or 2:1 (E:T) ratio, 6 hour incubation. (57A) Flow cytometry analysis was carried out using GFP control NK-92 cells. These data proof that GFP control NK-92 cells are about 99% GFP positive cells (green dots). (57B) Flow cytometry analysis of co-culture assay with GFP control NK-92 cells (target: T) and non-transduced or CD45CAR NK$^{45i}$-92 cells (effector: E). The ratio of co-culture assay was performed in 5:1 (57A) or 2:1 (E: T) (57C). Left panels showed that in co-culture with non-transduced or CD45CAR NK$^{45i}$-92 cells in 5:1 (E:T) ratio and right panels indicated that in co-culture with non-transduced or CD45CAR NK$^{45i}$-92 cells in 2:1 (E:T) ratio. Green dots in panels indicate the leftover target GFP NK-92 cells and red dots represent effector cells by co-culture assay. The incubation time was 6 h. All experiments were performed in duplicate. (57C) Bar graph shows percent cell lysis of GFP NK-92 cells by CD45CAR NK$^{45i}$-92 cells compared to non-transduced NK-92 cells at in 5:1 or 2:1 (E: T) ratio. Data are mean±S.D. CD45CAR NK$^{45i}$-92 cells shows about 20% cell lysis in 2:1 (E:T) ratio and about 55% cell lysis in 5:1 (E:T) ratio against GFP NK-92 cells compared to non-transduced NK-92 cells. This data suggests that CD45CAR NK$^{45i}$-92 cells effectively lyse GFP NK-92 cells that express CD45 on cell surface compared to non-transduced NK-92 cells in vitro co-culture assay.

Figure 57D:
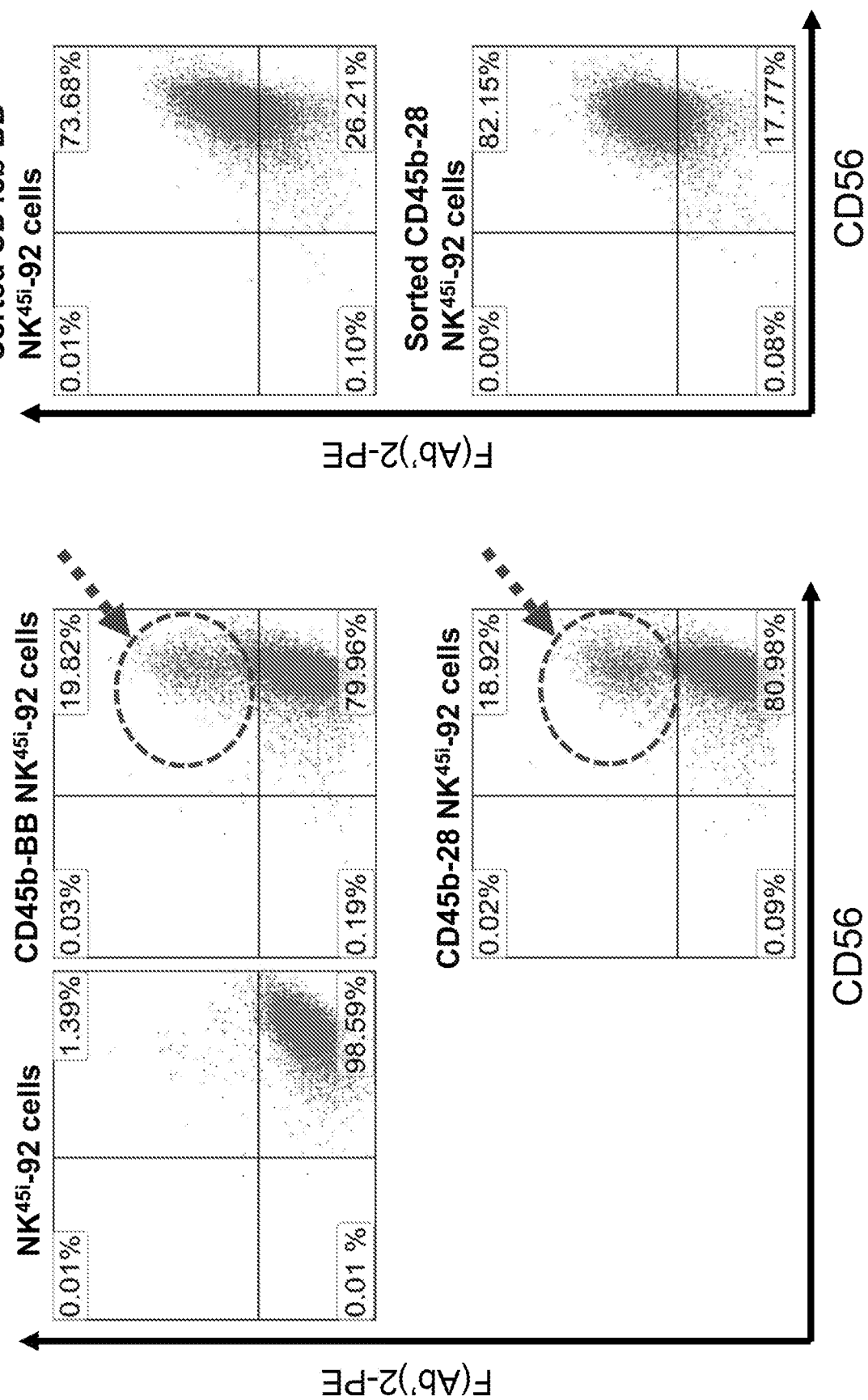

FIG. 57D. Transduction of CD45b-BB or CD45b-28 into NK$^{45i}$-92 cells and cell sorting of CD45b-BB or CD45b-28 transduced NK$^{45i}$-92 cells. The co-stimulatory domain for CDb-BB is 4-1BB while co-stimulatory domain for CD45b-28 is CD28. The expression levels of CD45b-BB or CD45b-28 on NK$^{45i}$-92 were determined by flow cytometry analysis (circled in blue at middle panel) compared to NK$^{45i}$-92 cells (left panel) after CD45b-BB or CD45b-28 on lentiviruses were transduced into NK$^{45i}$-92 cells. CD45b-BB or CD45b-28 on expressed NK$^{45i}$-92 cells were sorted and CD45b-BB or CD45b-28 on expression levels on cell surface were determined by Flow cytometry analysis (right panel). About 74% of CD45b-BB or 82% of CD45b-28 on expression on cell surface was detected by flow cytometry analysis.

Figure 57E:
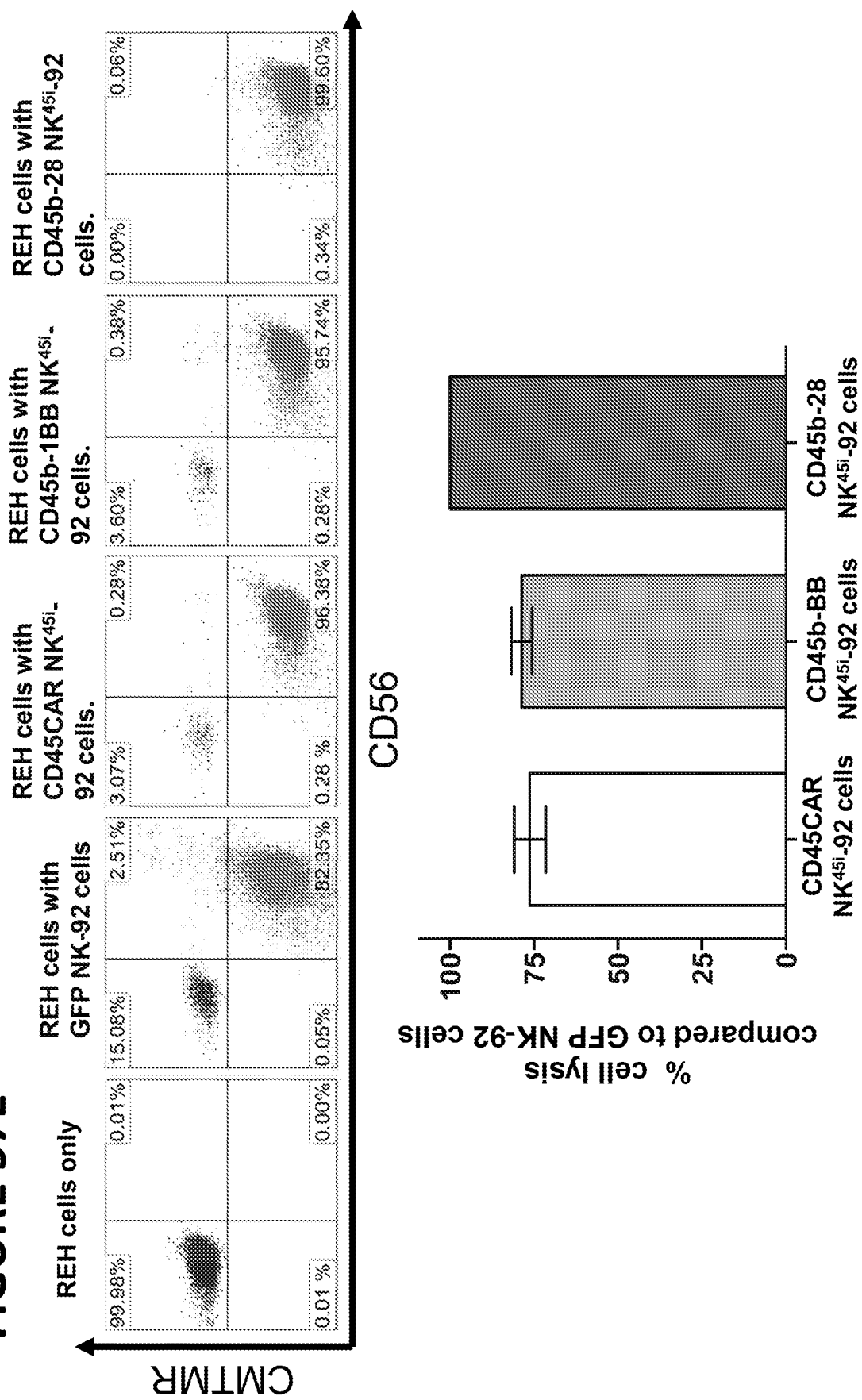

FIG. 57E. Co-culture assay with REH cells (target: T) and GFP NK-92 cells, CD45CAR NK$^{45i}$-92 cells, CD45b-BB NK$^{45i}$-92 cells or CD45b-28 NK$^{45i}$-92 cells at 5:1 (E:T) ratio and 20 hour incubation. Upper, Flow cytometry analysis of CREH cells only (left panel), in co-culture with REH cells and control GFP transduced NK-92 cells (2nd left panel), CD45CAR NK$^{45i}$-92 cells (middle panel), CD45b-BB NK$^{45i}$-92 cells (4$^{th}$ from left panel) or CD45b-28 NK$^{45i}$-92 cells (right panel). Blue dots in all of panels indicate the leftover target REH cells and red dots show effector GFP or CARs-NK-92 cells by co-culture assay. The incubation time was 20h and the ratio of effector NK-cells:target cell was 5:1. All experiments were performed in duplicate. Lower, Bar graph indicates the percent of cell lysis by CD45CAR NK$^{45i}$-92 cells, CD45b-BB NK$^{45i}$-92 cells or CD45b-28 NK$^{45i}$-92 cells compared to the control GFP NK92 cells in co-culture assay with REH cells. Data are mean±S.D. CD45CAR NK$^{45i}$-92 cells shows about 76% cell lysis, CD45b-BB NK$^{45i}$-92 cells shows about 79% cell lysis and CD45b-28 NK$^{45i}$-92 shows 100% cell lysis against REH cells compared to control GFP NK-92 cells. These data suggest that these 3 of CD45CARs NK$^{45i}$-92 cells effectively lyse REH cells which characterized as B-cells expressing CD45 compared to GFP-control NK-92 cells in vitro co-culture assay.

Figure 57F:
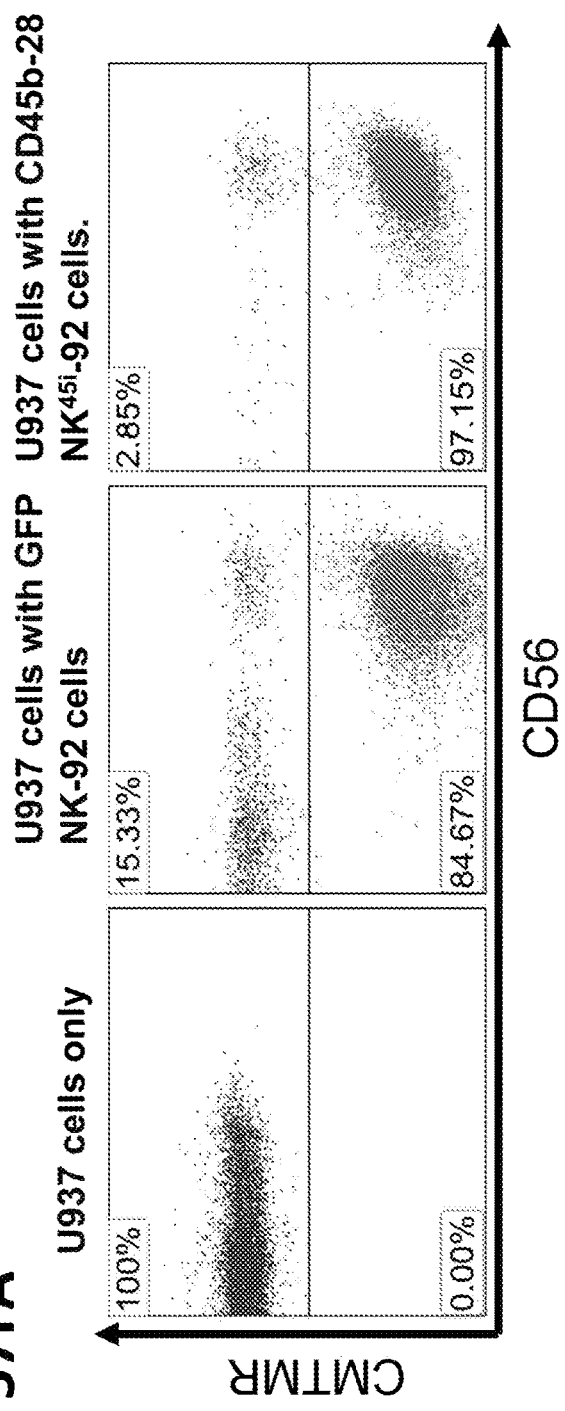
Figure 57F:
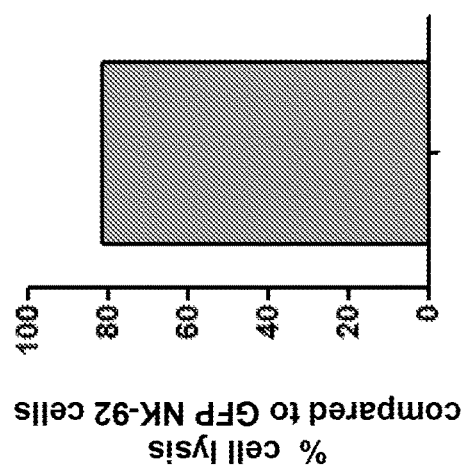

FIGS. 57FA-57FI. Co-culture assay with U937 cells (target: T) and GFP NK-92 cells or CD45b-28 NK$^{45i}$-92 cells. at 2:1 (E:T) ratio for 20 hours. FA, Flow cytometry analysis of U937 cells (monocytic leukemia cell line) only (left panel), in co-culture with U937 cells and control GFP transduced NK-92 cells (middle panel) or CD45b-28 NK$^{45i}$-92 cells (right panel). Blue dots in all of panels indicate the leftover target U937 cells and red dots show effector GFP or CD45b-28 NK$^{45i}$-92 cells by co-culture assay. The incubation time was 6h and the ratio of effector NK-cells:target cell was 2:1. FB, Bar graph indicates the percent of cell lysis by CD45b-28 NK$^{45i}$-92 cells compared to the control GFP NK92 cells in co-culture assay with U937 cells. CD45b-28 NK$^{45i}$-92 shows about 81% cell lysis against U937 cells compared to control GFP NK-92 cells.

Figure 57G:
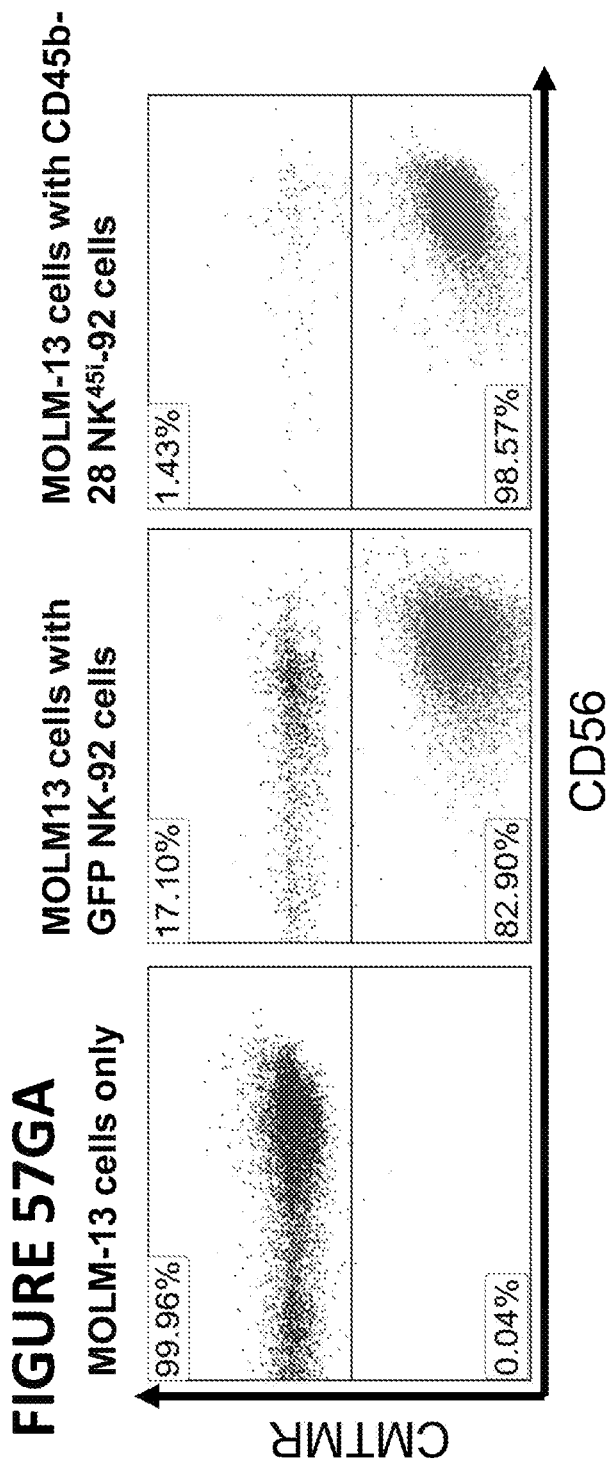
Figure 57G:
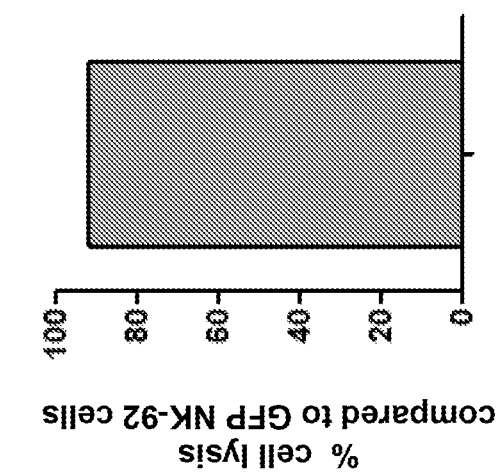

FIGS. 57GA-57GB. Co-culture assay with MOLM-13 cells (target: T) and GFP NK-92 cells or CD45b-28 NK$^{45i}$-92 cells at 5:1 (E:T) ratio for 20 hours. GA, Flow cytometry analysis of MOLM13 cells (monocytic leukemic cell line) only (left panel), in co-culture with Molm13 cells and control GFP transduced NK-92 cells (middle panel) or CD45b-28 NK$^{45i}$-92 cells (right panel). Blue dots in all of panels indicate the leftover target MOLM13 cells and red dots show effector FP or CD45b-28 NK$^{45i}$-92 cells by co-culture assay. The incubation time was 20h and the ratio of effector NK-cells:target cell was is 5:1. GB, Bar graph indicates the percent of cell lysis by CD45b-28 NK$^{45i}$-92 cells compared to the control GFP NK92 cells in co-culture assay with MOLM13 cells. CD45b-28 NK$^{45i}$-92 shows about 91.6% cell lysis against Molm13 cells compared to control GFP NK-92 cells.

Figure 57H:
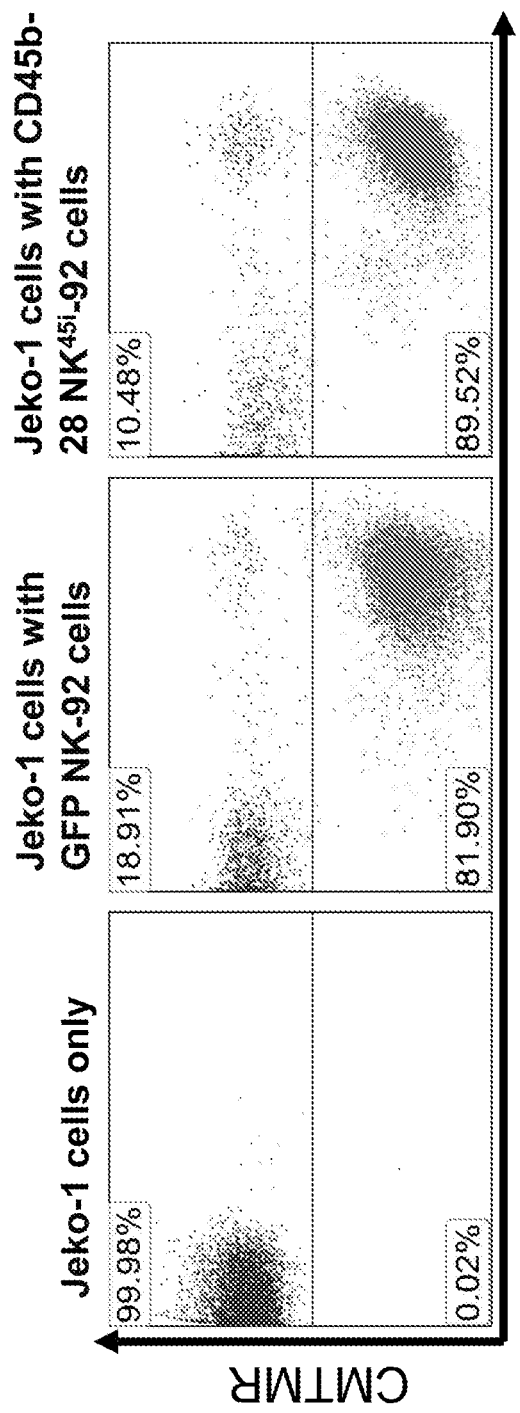
Figure 57H:
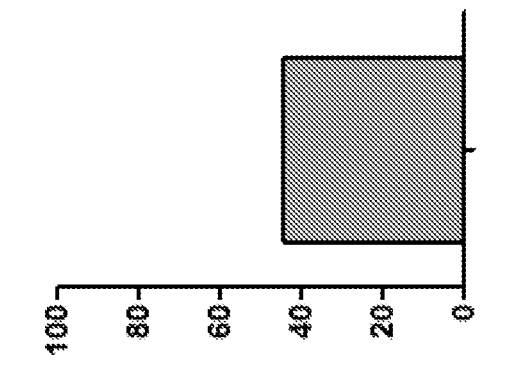

FIGS. 57HA-57HB. Co-culture assay with Jeko-1 cells (target: T) and GFP NK-92 cells or CD45b-28 NK$^{45i}$-92 cells at 2:1 (E:T) ratio for 6 hours. HA, Flow cytometry analysis of Jeko-1 cells (mantle cell lymphoma) only (left panel), in co-culture with Jeko-1 cells and control GFP transduced NK-92 cells (middle panel) or CD45b-28 NK$^{45i}$-92 cells (right panel). Blue dots in all of panels indicate the leftover target Jeko-1 cells and red dots show effector GFP or CD45b-28 NK$^{45i}$-92 cells by co-culture assay. The incubation time was 6h and the ratio of effector NK-cells:target cell was 2:1. HB. Bar graph indicates the percent of cell lysis by CD45b-28 NK$^{45i}$-92 cells compared to the control GFP NK92 cells in co-culture assay with Jeko-1 cells. CD45b-28 NK$^{45i}$-92 shows about 44.6% cell lysis against Jeko-1 cells compared to control GFP NK-92 cells.

FIGS. 57IA-57IB. Co-culture assay with SP53 cells (target: T) and GFP NK-92 cells or CD45b-28 NK$^{45i}$-92 cells at 2:1 (E:T) ratio for 6 hour incubation. IA, Flow cytometry analysis of SP53 cells (mantle cell lymphoma cell line) only (left panel), in co-culture with Jeko-1 cells and control GFP transduced NK-92 cells (middle panel) or CD45b-28 NK$^{45i}$-92 cells (right panel). Blue dots in all of panels indicate the leftover target SP53 cells and red dots show effector GFP or CD45b-28 NK$^{45i}$-92 cells by co-culture assay. The incubation time was 6h and the ratio of effector NK-cells:target cell was 2:1. IB, Bar graph indicates the percent of cell lysis by CD45b-28 NK$^{45i}$-92 cells compared to the control GFP NK92 cells in co-culture assay with SP53 cells. CD45b-28 NK$^{45i}$-92 shows about 45% cell lysis against SP53 cells compared to control GFP NK-92 cells.

Figure 57J:
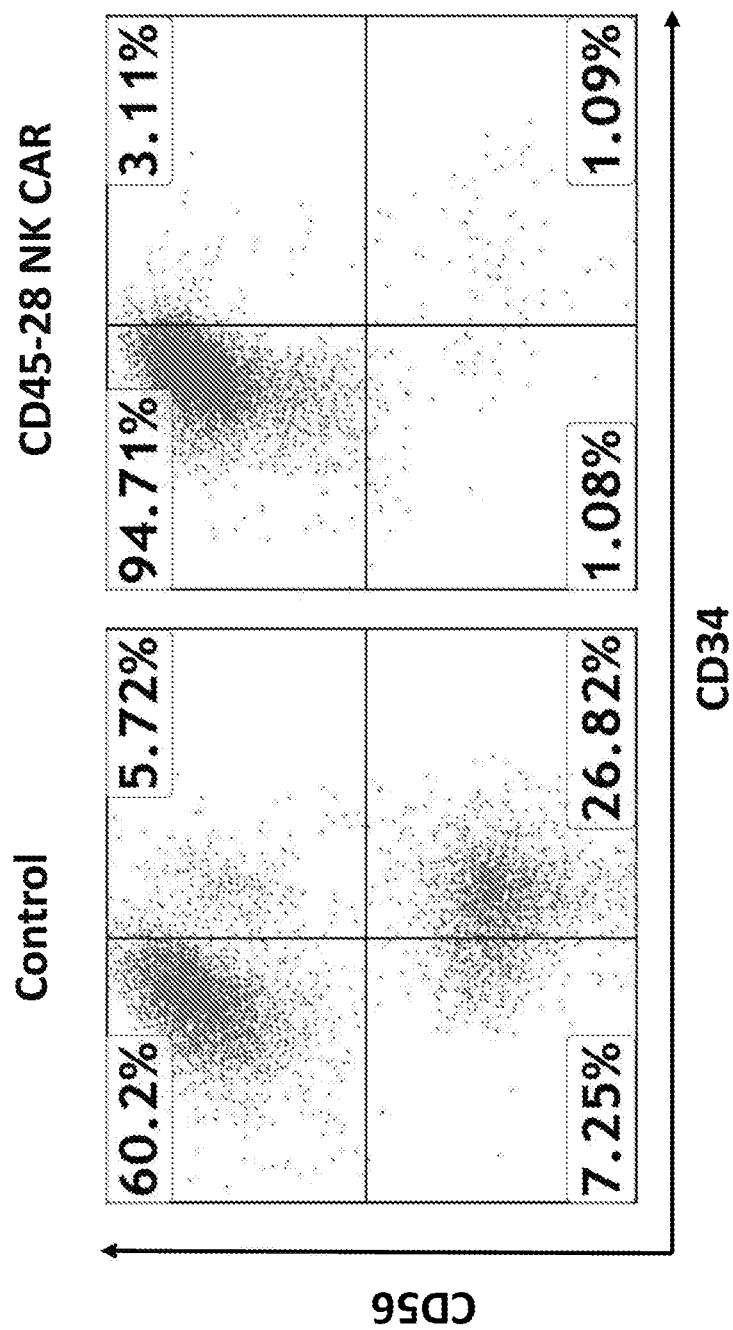

FIG. 57J. Elimination of CD34(+) umbilical cord blood stem cells in 48 hr co-culture. CD34(+) stem cells derived from human umbilical cord blood were co-cultured with either Control or CD45b-28 CAR NK cells for 48 hr prior to labeling at a low ratio of 2:1 (effective: target). About 96% of CD34(+) cells were eliminated comparing to the control.

Figure 58A:
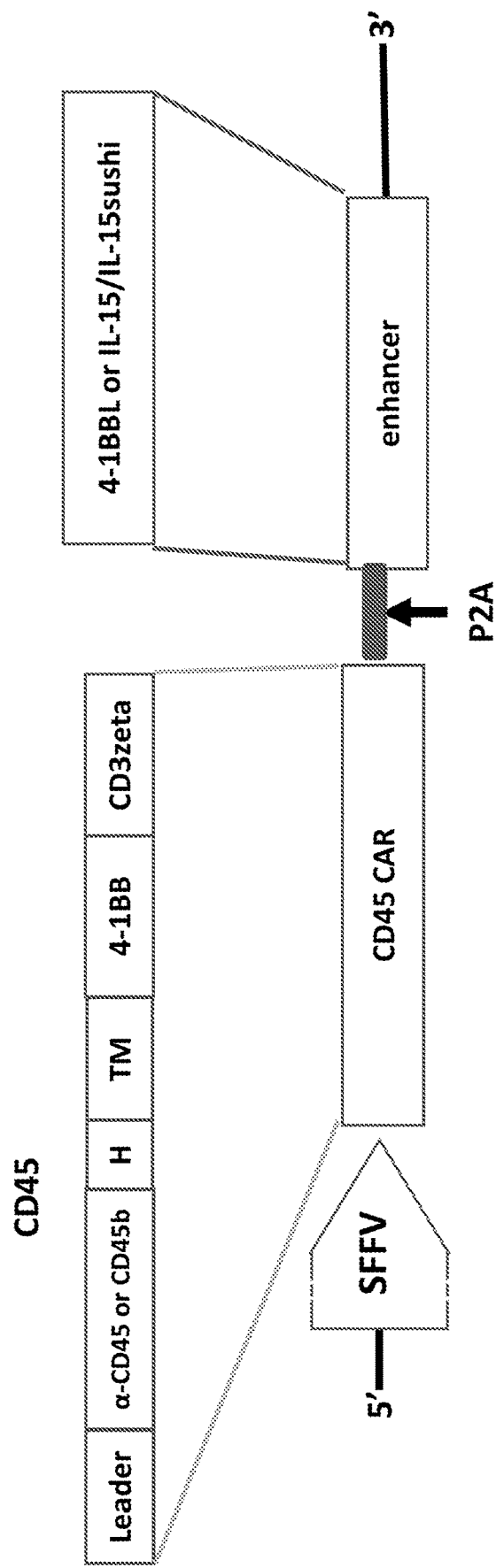

FIG. 58A. A Link by P2A schematic showing both cCAR-T and 4-1BBL or IL-15/IL-15sushi in a single construct. The construct consists of a SFFV promoter driving the expression of CAR and an enhancer, 4-1BBL. Upon cleavage of the linkers, the CD45 CAR (or CD45b CAR) and 4-1BBL or IL-15/IL-15sush split and engage upon targets expressing CD45. CD45 CAR T cells received not only costimulation through the CD28 but also 4-1BB ligand (4-1BBL or CD137L) or IL-15/IL-15sushi. The CD3-zeta signaling domain completes the assembly of this CAR-T.

Figure 58B:
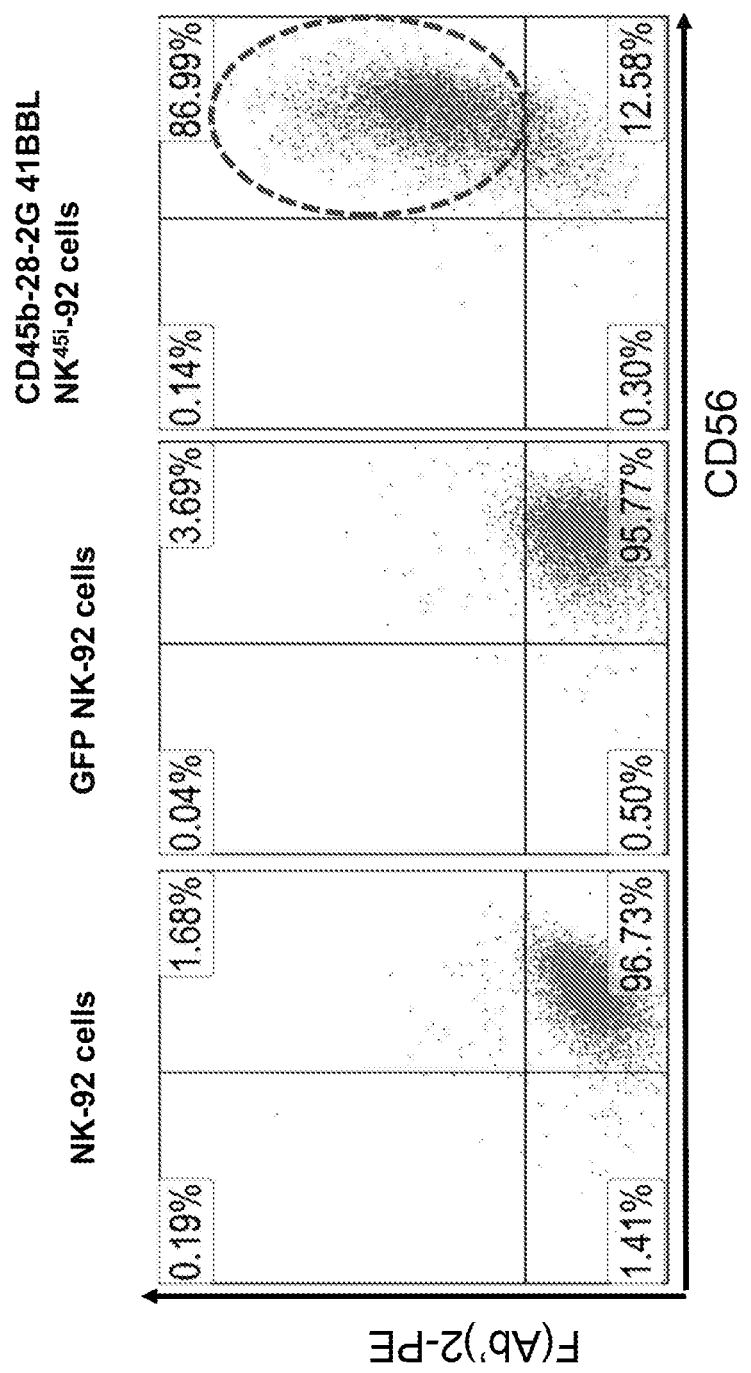

FIG. 58B. Surface CD45b CAR expression levels on CD45b-28-2G-4-1BBL CAR transduced NK$^{45i}$-92 cells were determined using flow cytometry analysis. Left panel (NK92 cells) and middle panel (GFP-NK92) indicated negative control and right panel showed the surface expression of CD45b CAR which was labeled using goat anti-mouse F(AB')2-PE against ScFv region (circled in blue).Transduced cells expressed 86.99% of CD45b-CAR on the cell surface.

Figure 58C:
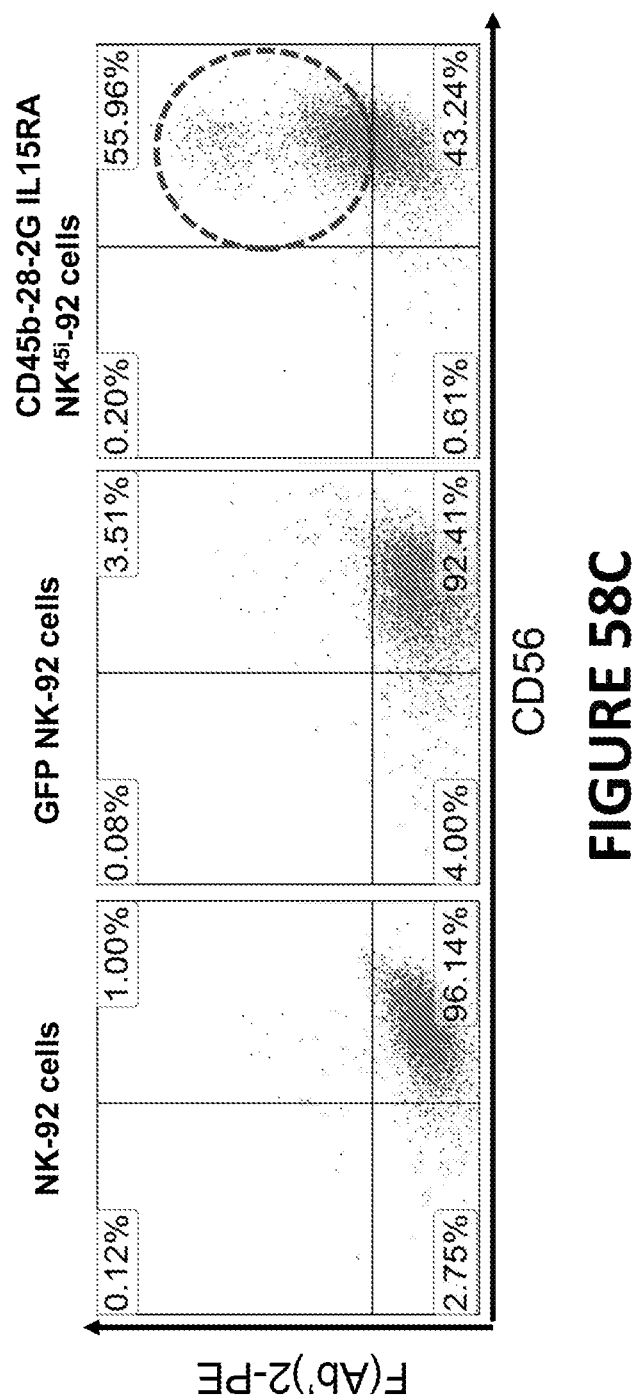

FIG. 58C. Surface CD45b CAR expression levels on CD45b-28-2G-IL15/IL-15sushi CAR transduced NK45i-92 cells were determined using flow cytometry analysis. Left panel(NK92 cells) and middle panel (GFP-NK92) indicated negative control and right and right panel showed the surface expression of CD45b CAR which was labeled using goat anti-mouse F(AB')2-PE against ScFv region (circled in blue). CD45b-28-2G IL15RA CD45b-28-2G-IL-15/IL-15sushi) virus transduced cells expressed 55.96% of CD45b-CAR on cells surface compared to negative control cells.

FIGS. 59A-59B. Schematic diagram to elucidate the construct and its expression in T or NK cells. (59A) a combination of CAR, (third generation), and IL-15/sushi domain of the IL-15 alpha receptor, is assembled on an expression vector and their expression is driven by the SFFV promoter. CAR with IL-15/sushi is linked with the P2A self-cleaving sequence. The IL-15/sushi portion is composed of IL-2 signal peptide fused to IL-15 and linked to sushi domain via a 26-amino acid poly-proline linker. (59B) CAR and IL-15/sushi are present on the T or NK cells.

FIG. 59C. Surface CD45b CAR expression levels on CD45b-28-2G-IL-15/IL-15sushi CAR transduced NK$^{45i}$-92 cells were determined using flow cytometry analysis. Left panel(NK92 cells) and middle panel (GFP-NK92) indicated negative control and right and right panel showed the surface expression of CD45b CAR which was labeled using goat anti-mouse F(AB')2-PE against ScFv region (circled in blue). CD45b-28-2G IL-15/IL-15sushi virus transduced cells expressed 55.96% of CD45b-CAR on cells surface compared to negative control cells. CD45b-28-2G-IL-15/IL-15sushi NK cells showed a robust functional activity.

Figure 60A:
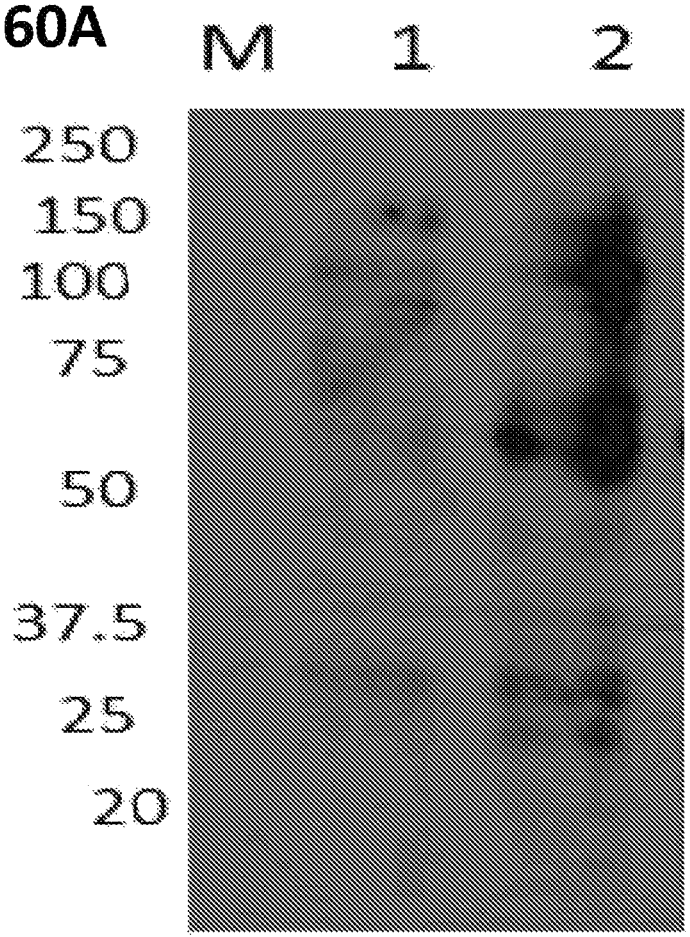
Figure 60B:
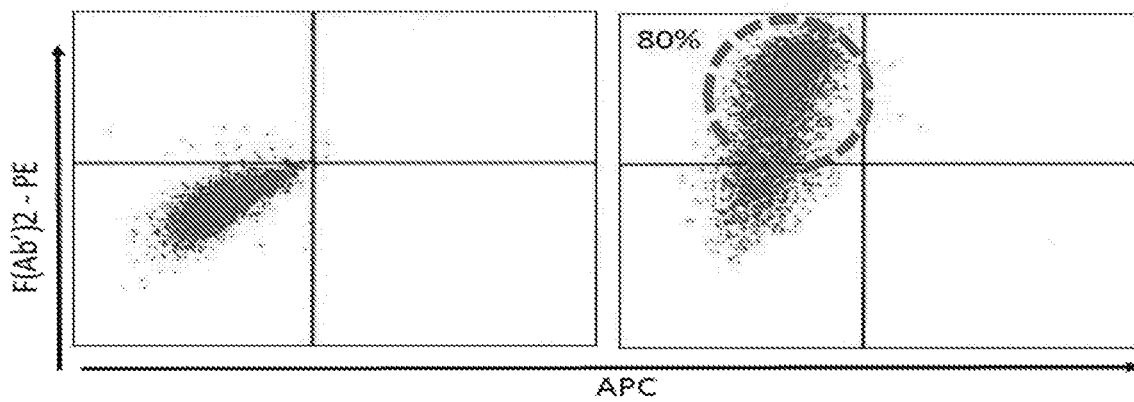

FIGS. 60A-60B. CD4IL-15/IL-15sushi expression. (60A) HEK-293FT cells were transfected with lentiviral plasmids for GFP (lane 1) and CD4IL-15/IL-15sushi CAR (lane 2). 48 hours after transfection, supernatant was removed, and cells were also removed for a Western blot with mouse anti-human CD3z antibody. (60B) HEK-293 cells were transduced with either GFP (left) or CD4IL-15/IL-15sushi-CAR (right) viral supernatant from transfected HEK-293FT cells. After 3 days incubation, cells were harvested, stained with goat-anti-mouse F(Ab')2 and analyzed by flow cytometry.

Figure 61:
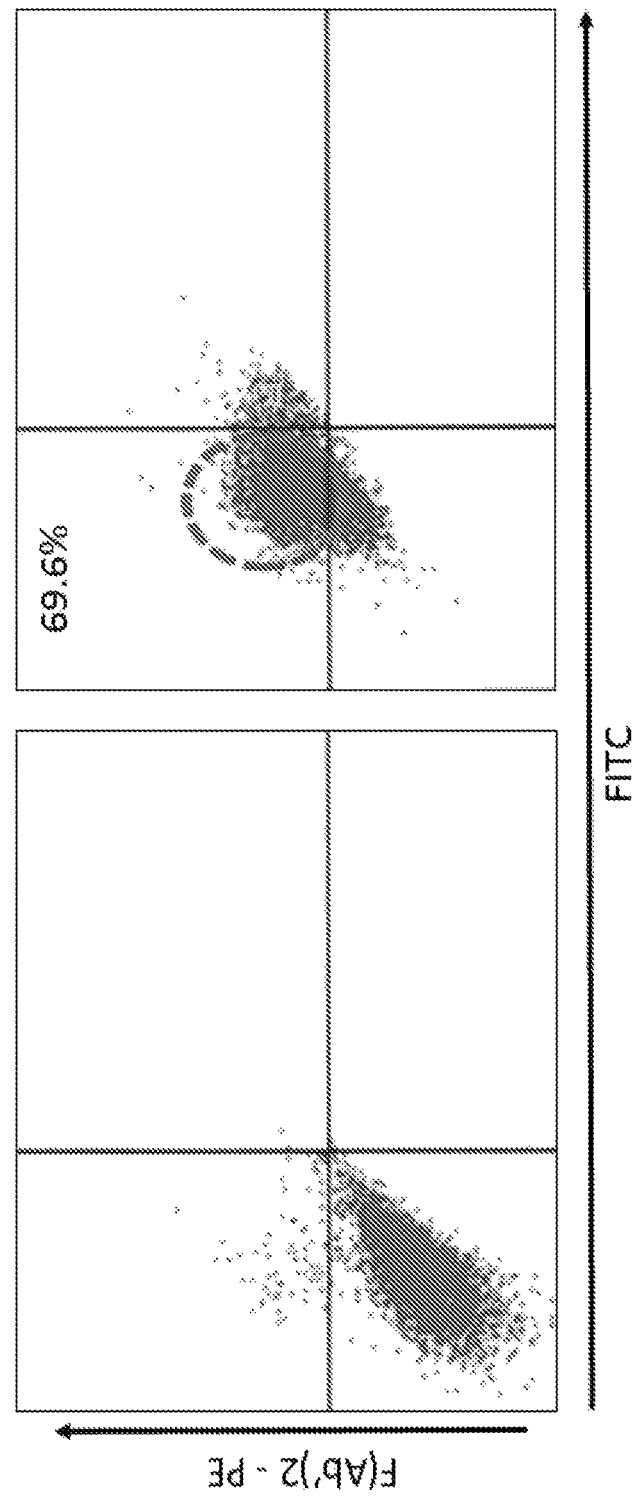

FIG. 61. Transduction of NK cells with CD4IL-15/IL-15sushi CAR. NK-92 cells were transduced with either GFP (left) or CD4 IL-15/IL-15sushi CAR (right) viral supernatant from transfected HEK-293FT cells. A second transduction was performed 24 hours after the first. 24 hours after the second transduction, cells were harvested, washed and moved to tissue culture plates with fresh media and IL-2. After 3 days incubation, cells were harvested and stained with goat-anti-mouse F(Ab')2 antibody or goat IgG (control) at 1:250 for 30 minutes. Cells were washed and stained with streptavidin-PE conjugate at 1:500, washed, suspended in 2% formalin, and analyzed by flow cytometry.

Figure 62:
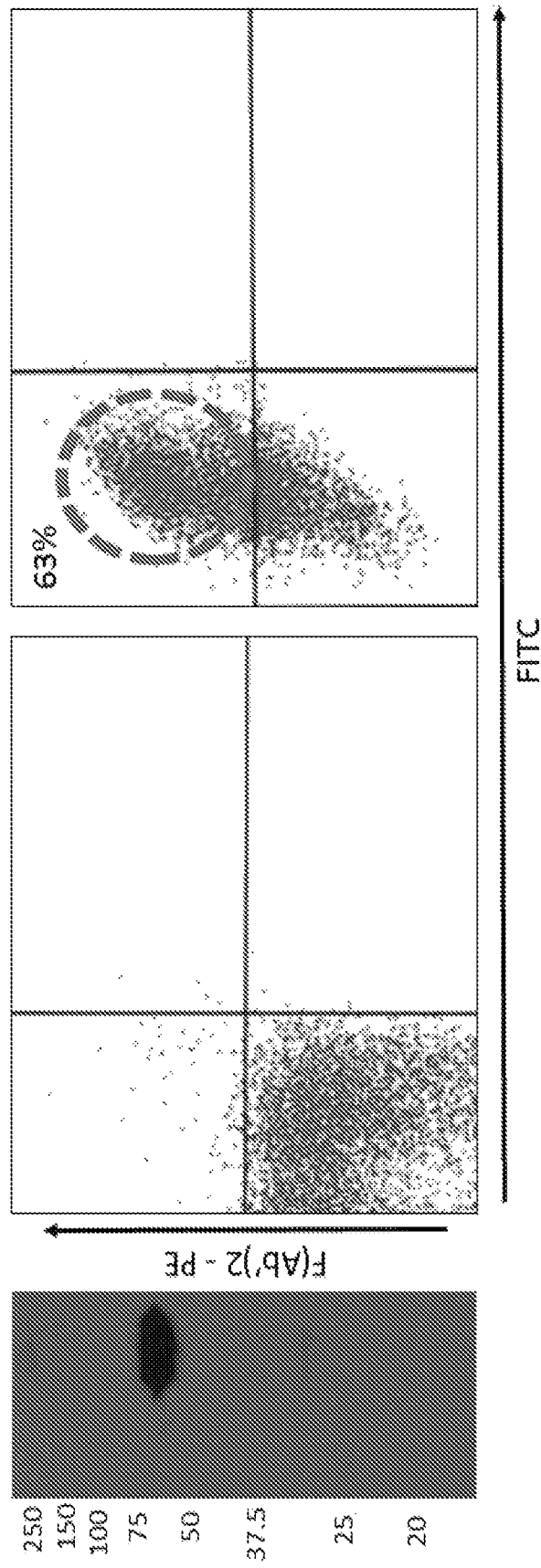

FIG. 62. Transduction of T cells with CD4IL15RACAR (CD4IL-15/IL-15sushi). Left is the Western blot. HEK-293FT cells were transfected with lentiviral plasmids for GFP (lane 1) and CD4IL15RA-CAR (lane 2). 48 hours after transfection, supernatant was removed, and cells were also collected for a Western blot with mouse anti-human CD3zeta antibody. Right is CD4IL15RACAR expression. Activated T cells from cord blood buffy coat were transduced with either GFP (left) or concentrated CD4IL15RACAR (right) viral supernatant from transfected HEK-293FT cells. A second transduction was performed 24 hours after the first. 24 hours after the second transduction, cells were harvested, washed and moved to tissue culture plates with fresh media and IL-2. After 3 days incubation, cells were harvested and stained with goat-anti-mouse F(Ab') transduced with either GFP (left) or CD4IL15RA CAR (right). Cells were washed and stained with streptavidin-PE conjugate at 1:500, washed, suspended in 2% formalin, and analyzed by flow cytometry.

Figure 63A:
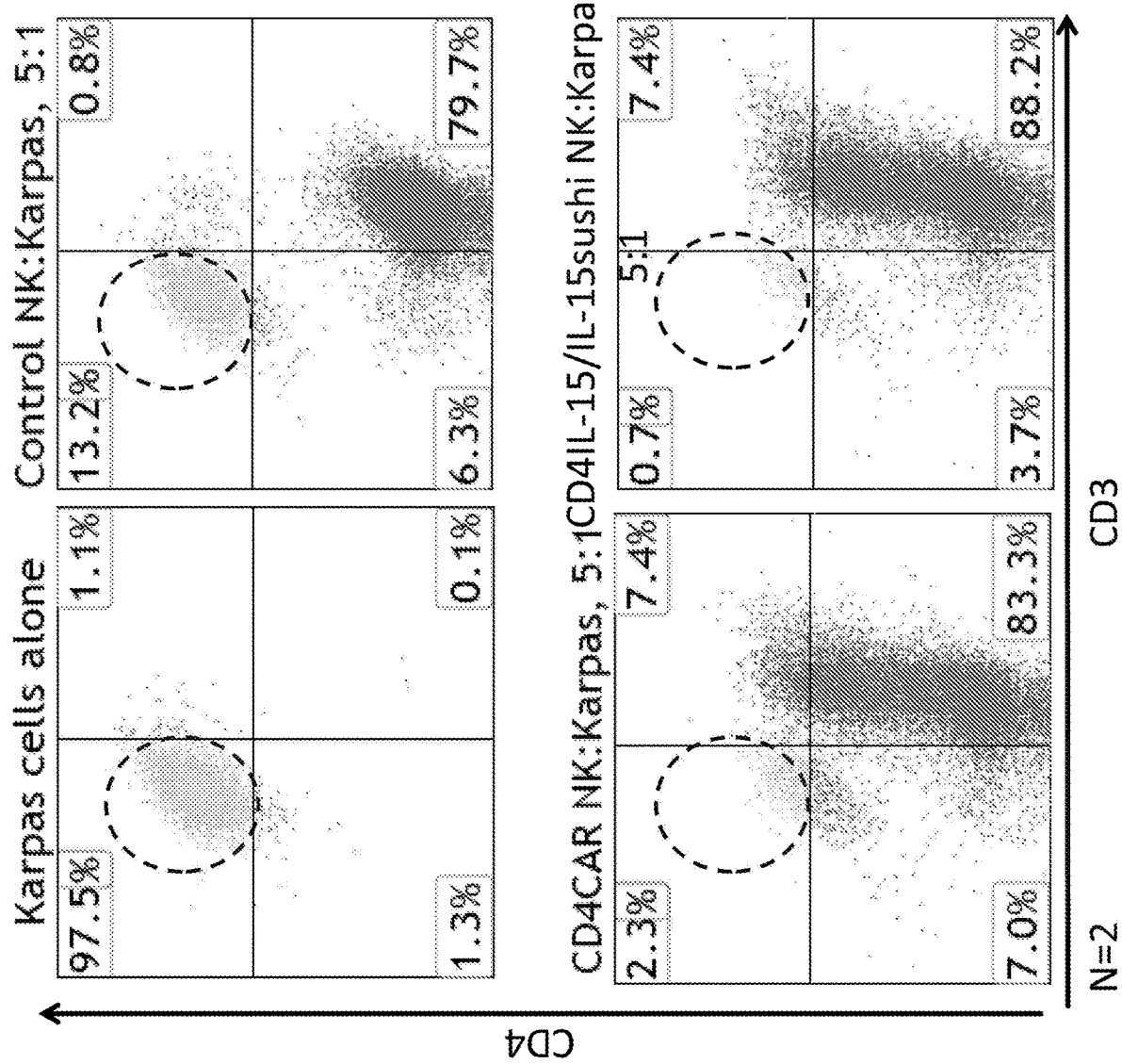
Figure 63B:
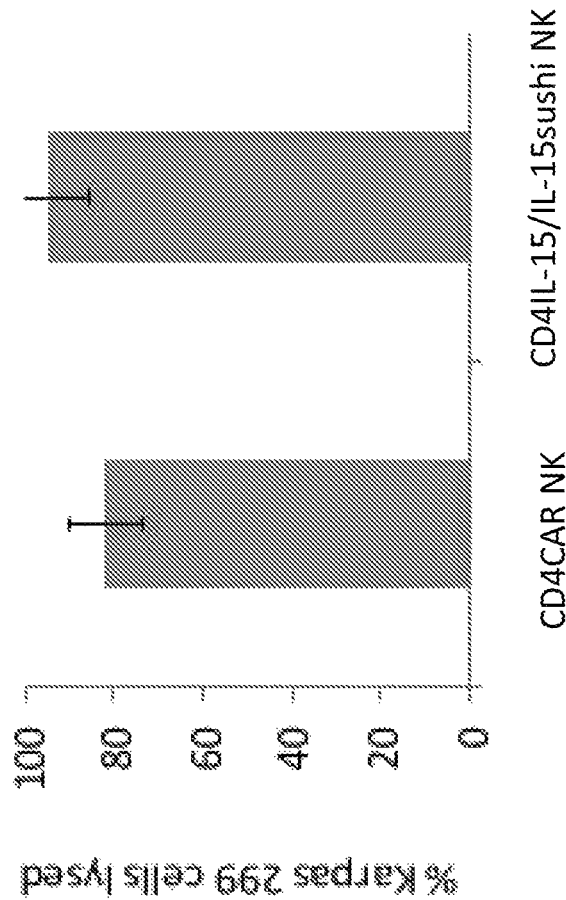

FIGS. 63A-63B. CD4CAR NK-92 cells and CD4IL-15/IL-15sushi CAR NK-92 cells eliminate KARPAS 299 T leukemic cells in co-culture. (63A) NK-92 cells transduced with either GFP control (upper right), CD4CAR (lower left), or CD4IL-15/IL-15sushi (lower right) lentiviral supernatant were incubated with KARPAS 299 cells at a ratio of 5:1. After 4 hours co-culture, cells were stained with mouse-anti-human CD4 (APC) and CD3 (PerCp) antibodies and analyzed by flow cytometry (N=2). The upper left panel shows labeled Karpas 299 cells alone. The percentage of target cells lysed is shown in the graph (63B).

Figure 64:
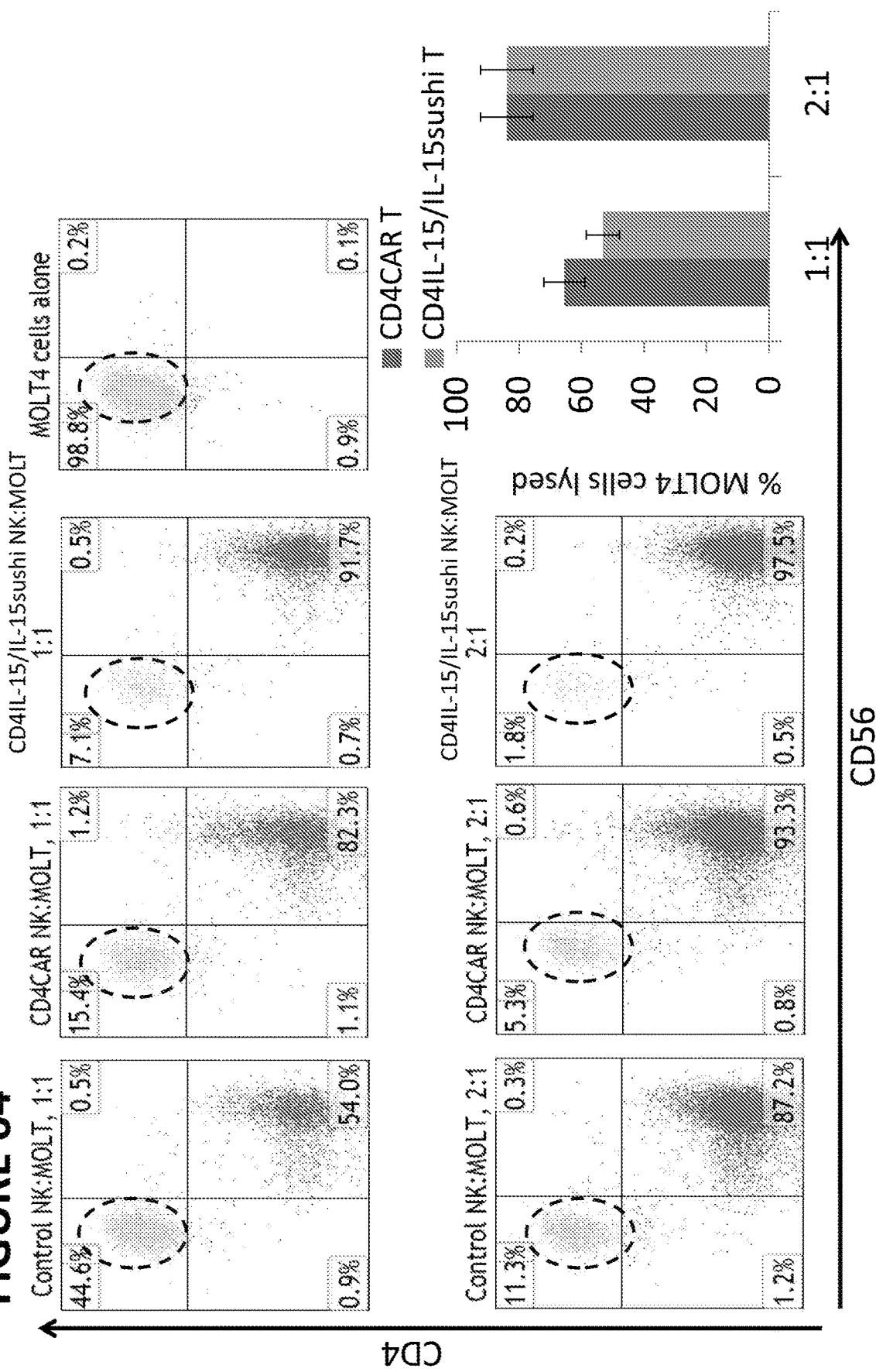

FIG. 64. CD4CAR NK-92 cells and CD4IL-15/IL-15sushi CAR NK-92 cells eliminate MOLT4 T leukemic cells in co-culture. NK-92 cells transduced with either GFP control (left), CD4CAR (center), or CD4IL-15/IL-15sushi (second from right) lentiviral supernatant were incubated with MOLT4 cells at effector:target ratios of 1:1 or 2:1. After overnight co-culture, cells were stained with mouse-anti-human CD4 (APC) and CD56 (PerCp) antibodies and analyzed by flow cytometry (N=2). The upper right panel shows labeled MOLT4 cells alone. The percentage of target cells lysed is shown in the graph.

Figure 65B:
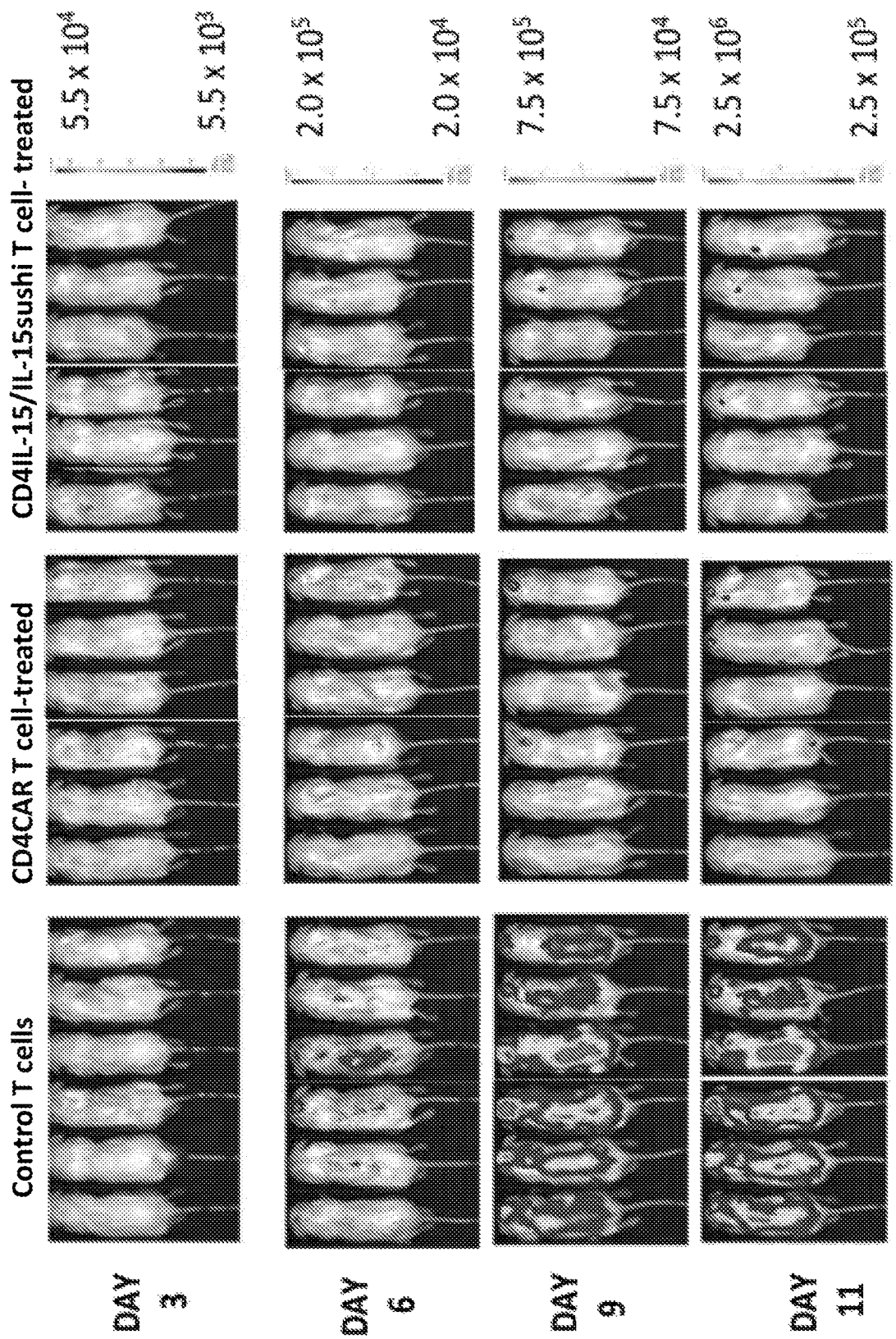

FIGS. 65A and 65B. CD4CAR and CD4IL-15/IL-15sushi CAR T cells demonstrate anti-leukemic effects in vivo. NSG mice were sublethally irradiated and intravenously (tail vein) injected the following day with luciferase-expressing MOLM13 cells to induce measurable tumor formation (65A). MOLM-13 cells are nearly 100% CD4+. After 3 days, the mice were intravenously injected with one course of 8×10$^6$ CD4CAR, or CD4IL-15/IL-15sushi CAR T cells, or vector control T control cells. On days 3, 6, 9, and 11, mice were injected subcutaneously with RediJect D-Luciferin and subjected to IVIS imaging (65B).

Figure 65C:
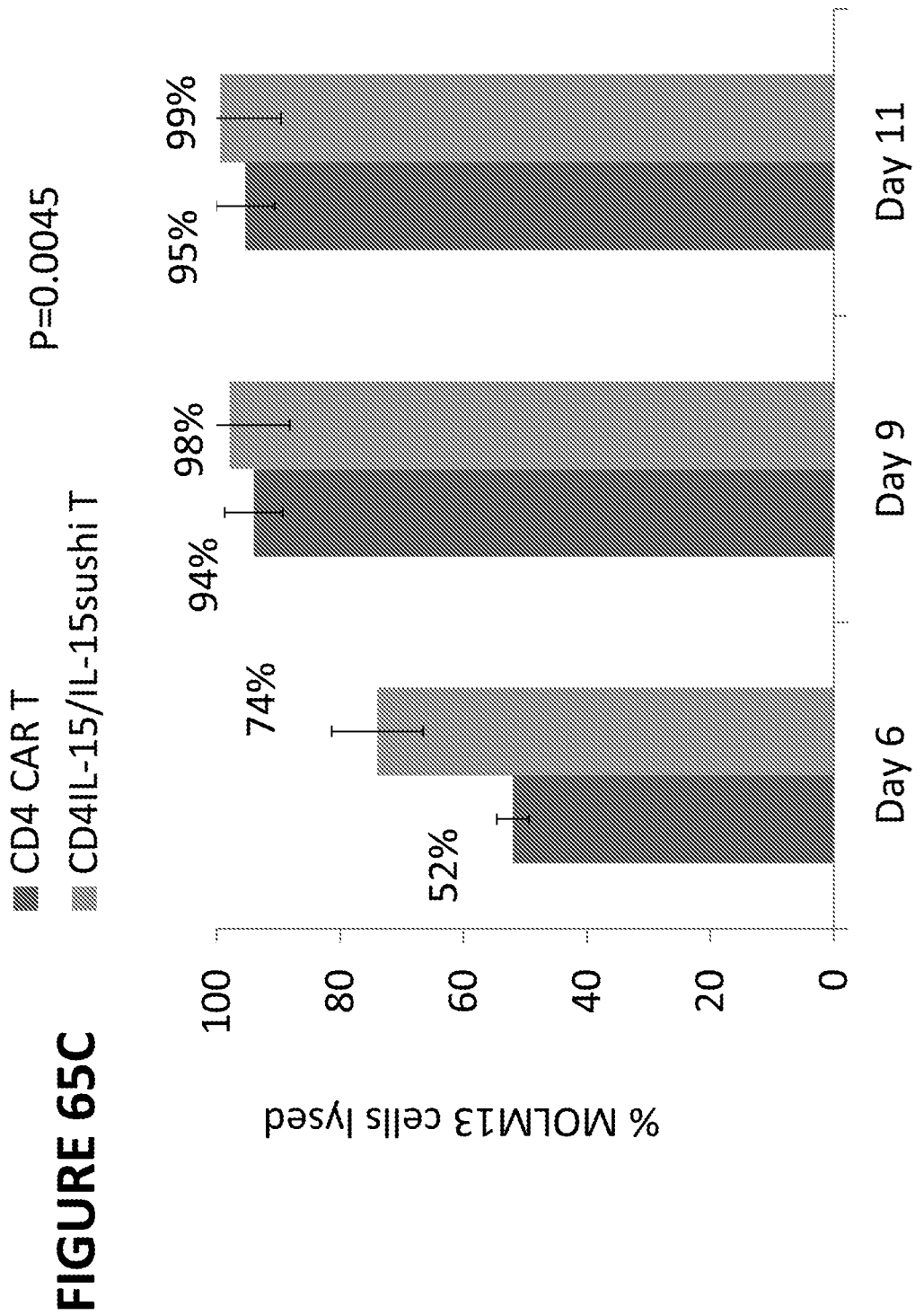
Figure 65D:
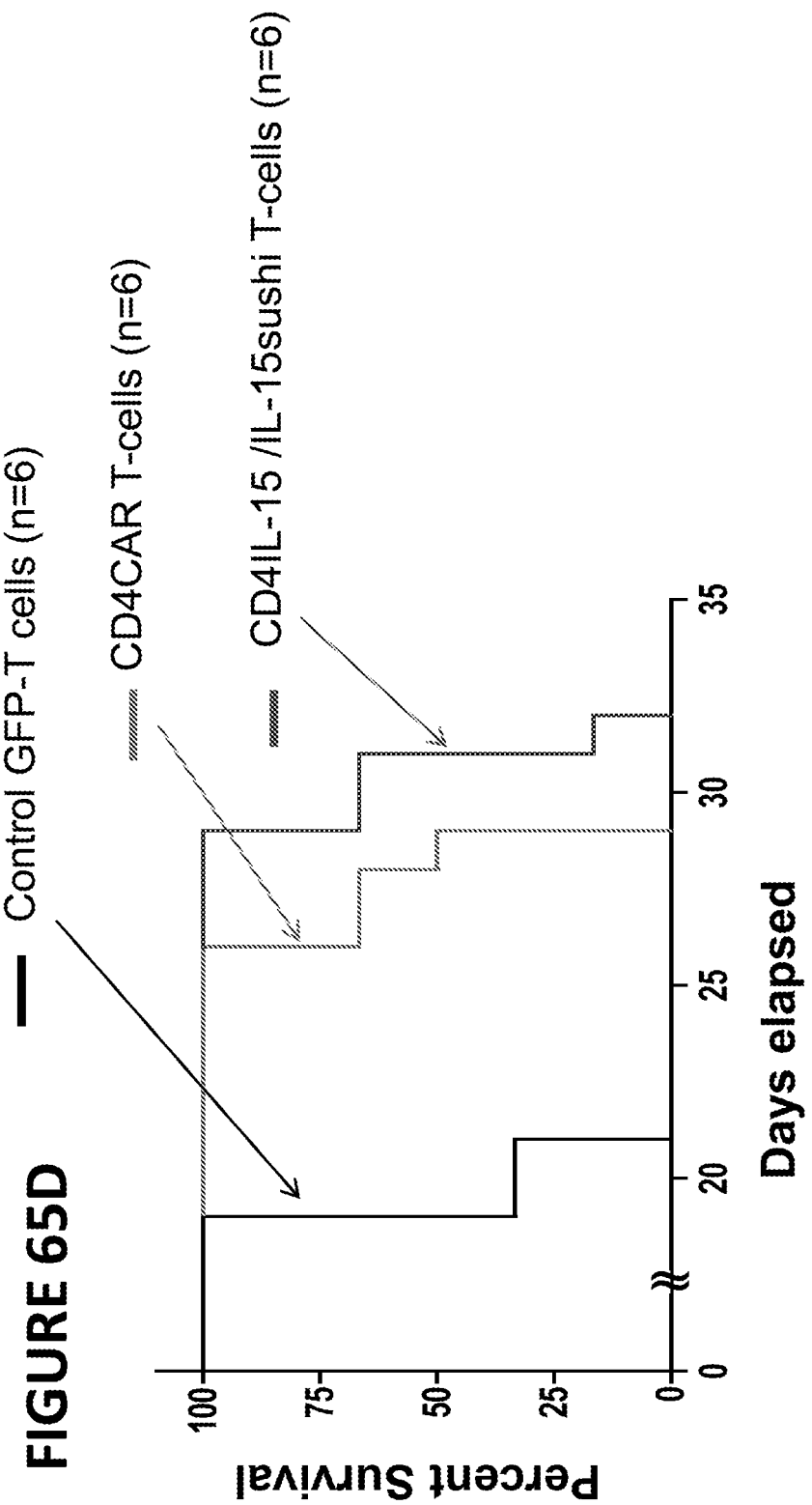

FIGS. 65C and 65D. (65C) Average light intensity measured for the CD4CAR and CD4IL-15/IL-15sushi CAR T injected mice was compared to that of vector control T injected mice, and correlated with remaining tumor burden to determine a percent lysis. (65D) Percent survival of mice was measured and compared between the three groups.

FIGS. 66A and 66B. CD4IL15/IL-15sushi CAR NK cells demonstrate robust anti-leukemic activity under stressful condition in vivo. NSG mice were sublethally irradiated and intravenously (tail vein) injected the following day with luciferase-expressing Jurkat cells to induce measurable tumor formation (66A). Jurkat cells are less than 60% CD4+. After 3 days, the mice were intravenously injected with one course of 8×10$^6$ CD4CAR, or CD4IL-15/IL-15sushi CAR NK cells, or vector control NK cells. On days 3, 7, 10, and 14, mice were injected subcutaneously with RediJect D-Luciferin and subjected to IVIS imaging (66B).

Figure 66C:
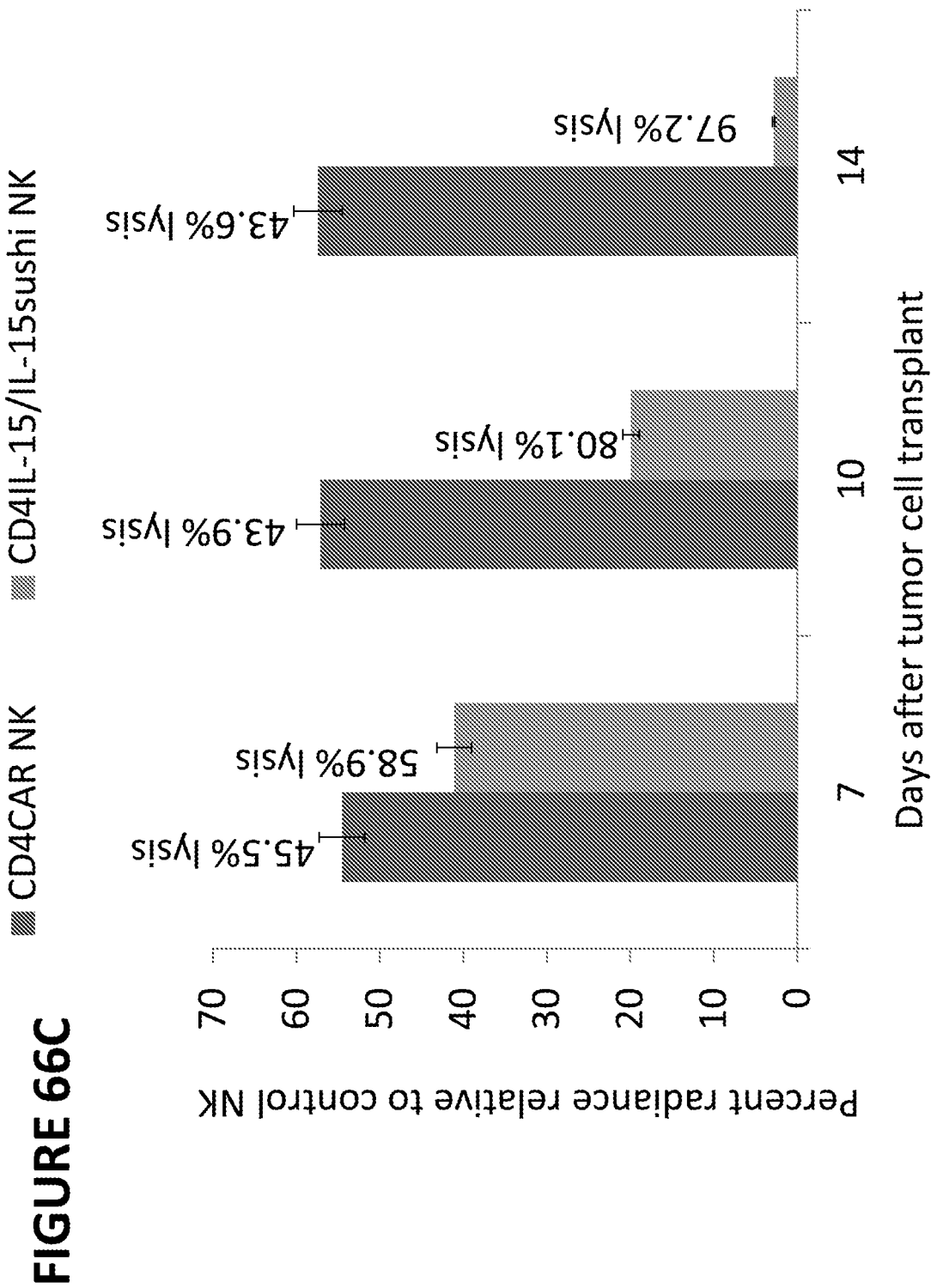
Figure 66D:
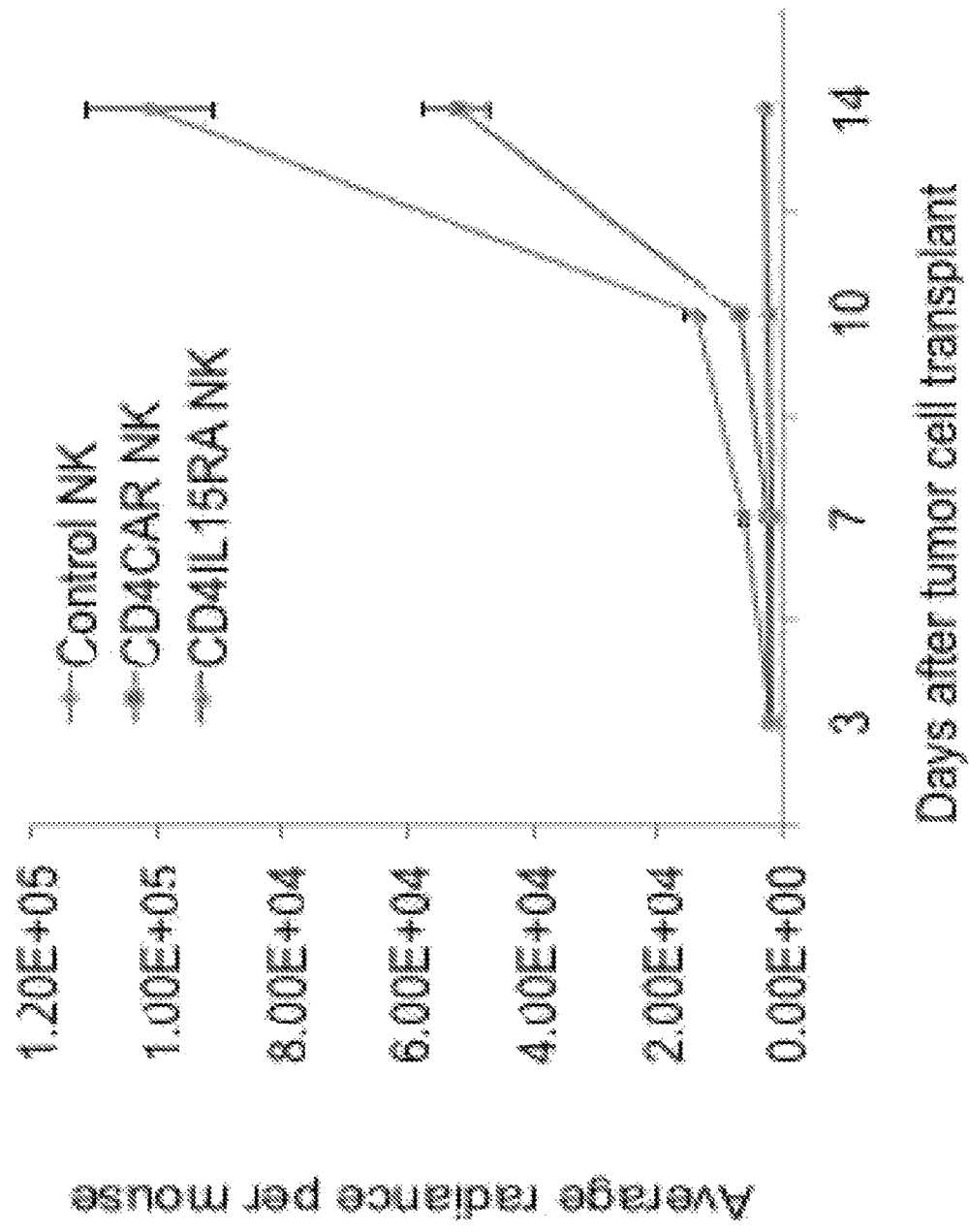

FIGS. 66C and 66D. Average light intensity measured for the CD4CAR and CD4IL-15/IL-15sushi NK injected mice was compared to that of vector control NK injected mice, and correlated with remaining tumor burden to determine a percent lysis.

Figure 67B:
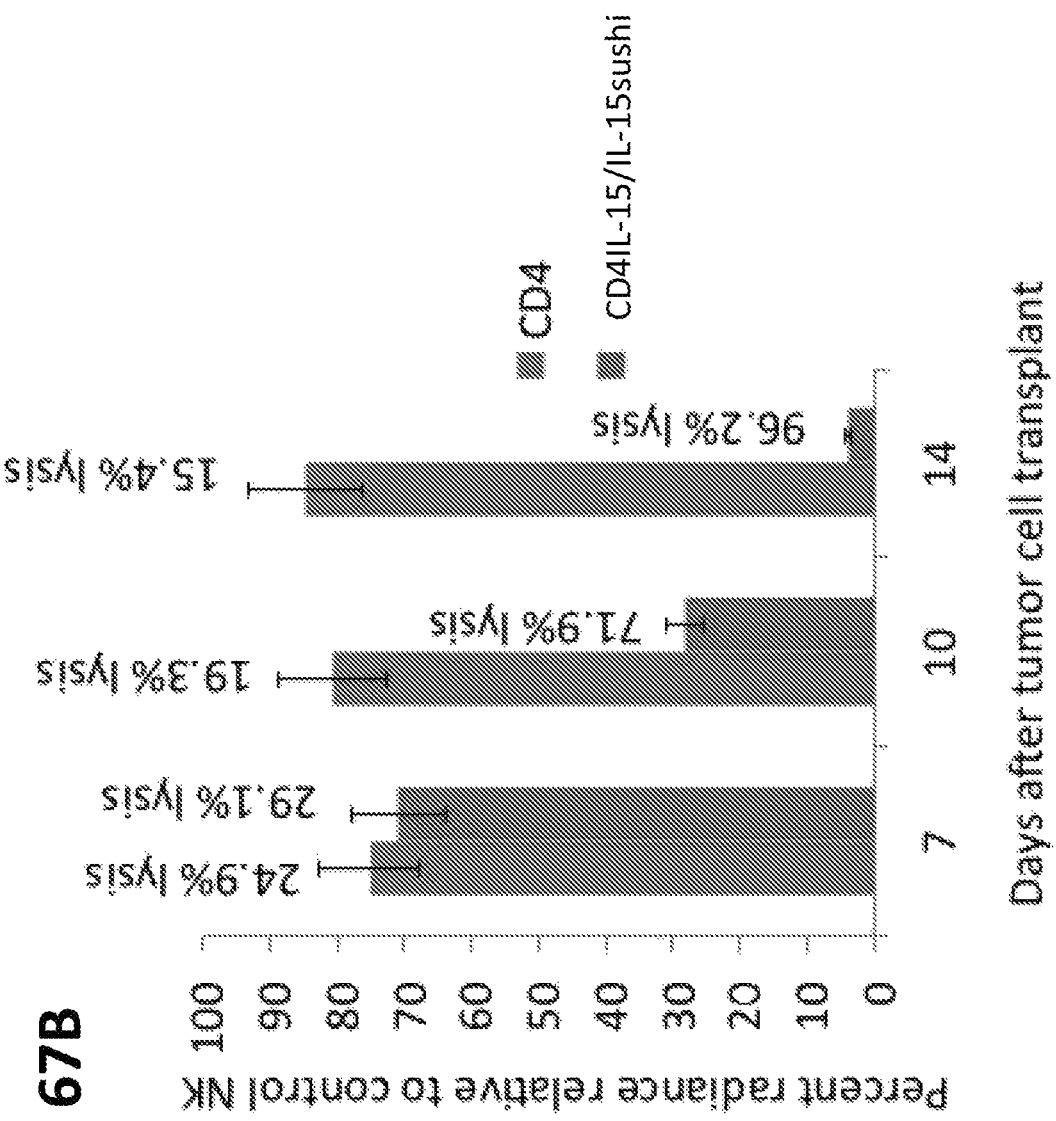

FIG. 67. Repeat of the in vivo experiment demonstrating robust lysis of Jurkat tumor cells by CD4I-15/IL-15sushi CAR NK cells showing similar results to those described in FIG. 66.

FIGS. 68A-68B. Effect of secreted IL-15/IL-15sushi on CAR and non-transduced neighboring cells. NK-92 cells stably expressing either CD4CAR or CD4IL15RA (CD4IL-15/IL-15sushi) were mixed in a 50:50 ratio with NK-92 cells stably expressing GFP. These cells were co-cultured either with IL-2 added or no IL-2. (68A) Photographs taken on a fluorescent microscope at 20× on Day 0 (start of co-culture) and Day 7, without the addition of IL-2. (68B) Total cell counts calculated throughout the experiment (up to Day 14) for NK-92 cells co-cultured with or without IL-2.

Figure 69:
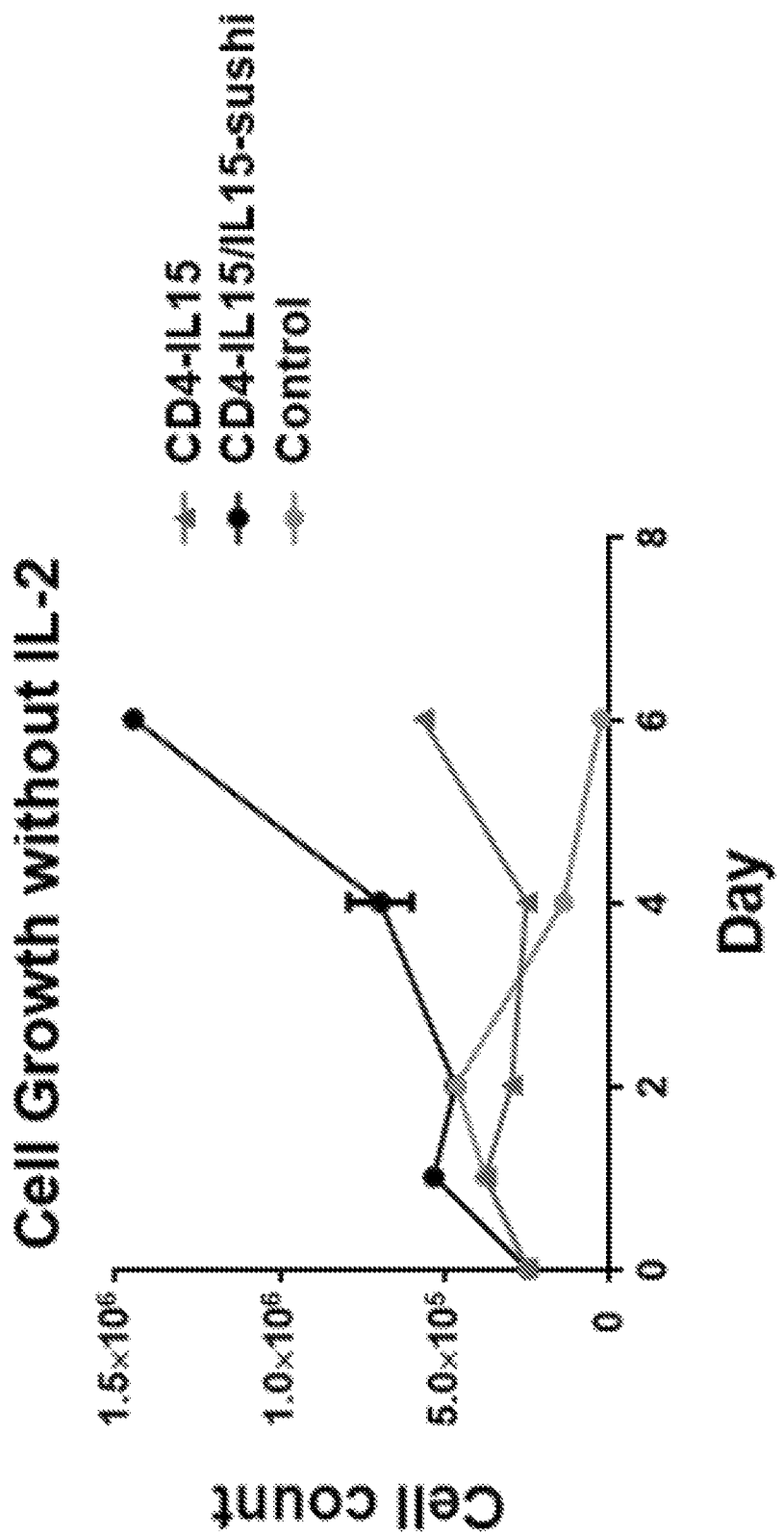

FIG. 69. Comparing the effect of secreted IL-15 and IL-15/IL-15sushi on NK-92 cell growth. CD4IL-15/IL-15sushi, CD4 IL-15, and control transduced NK-92 cells were cultured from 250,000 cells in regular NK cell media but in the absence of IL-2 for up to 6 days. Both transduced cells had 10% surface CAR expression, while CD4IL15-IL15sushi transduced NK-92 cells were able to expand at a rate approximately 3-fold higher than the CD4 IL-15 transduced NK-92 cells on day 6. On day 4, the growth rate of CD4 IL-15 transduced NK-92 cells were slightly higher than the Control, but significantly below the CD4 IL-15/IL15sushi transduced NK-92 cells. This study pin-points the importance of co-expression functional complex of IL-15/IL-15sushi in promoting NK-92 cell growth.

Figure 70:
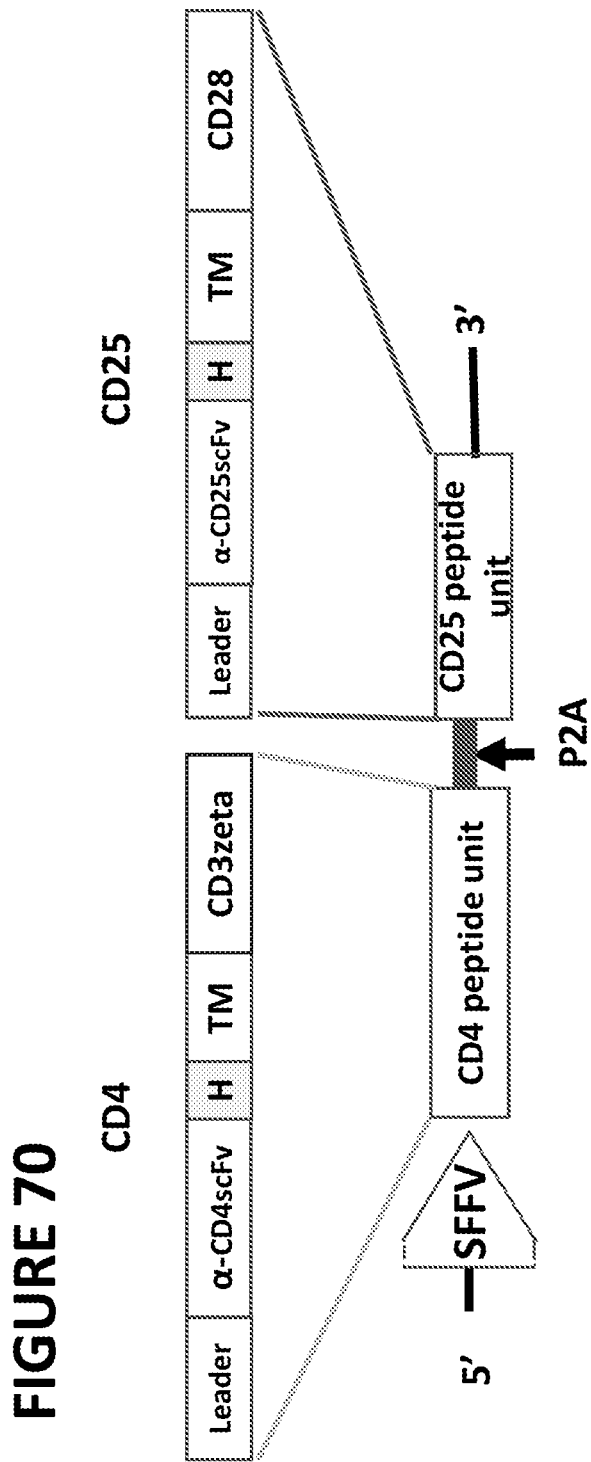

FIG. 70. A schematic showing the Treg CAR T construct targeting Tregs. The construct consists of a SFFV promoter driving the expression of two units of chimeric antigen receptors linked by a P2A peptide. Each unit contains a CD45 leader peptide sequence (signal peptide). Upon cleavage of the linker, two units of peptide are divided and engage upon targets expressing CD4 and CD25. The CD4 chimeric antigen receptor polypeptide unit comprises a signal peptide, a CD4 antigen recognition domain, a hinge region, a transmembrane domain and CD3 zeta chain; CD25 chimeric antigen receptor polypeptide unit comprises a signal peptide, a CD25 antigen recognition domain, a hinge region, a transmembrane domain, a co-stimulatory domain (s). The Treg CAR can potentiate the lysis activity of a cell co-expressing CD4 and CD25 while minimizing a cell bearing CD4 or CD25 antigen.

Figure 71B:
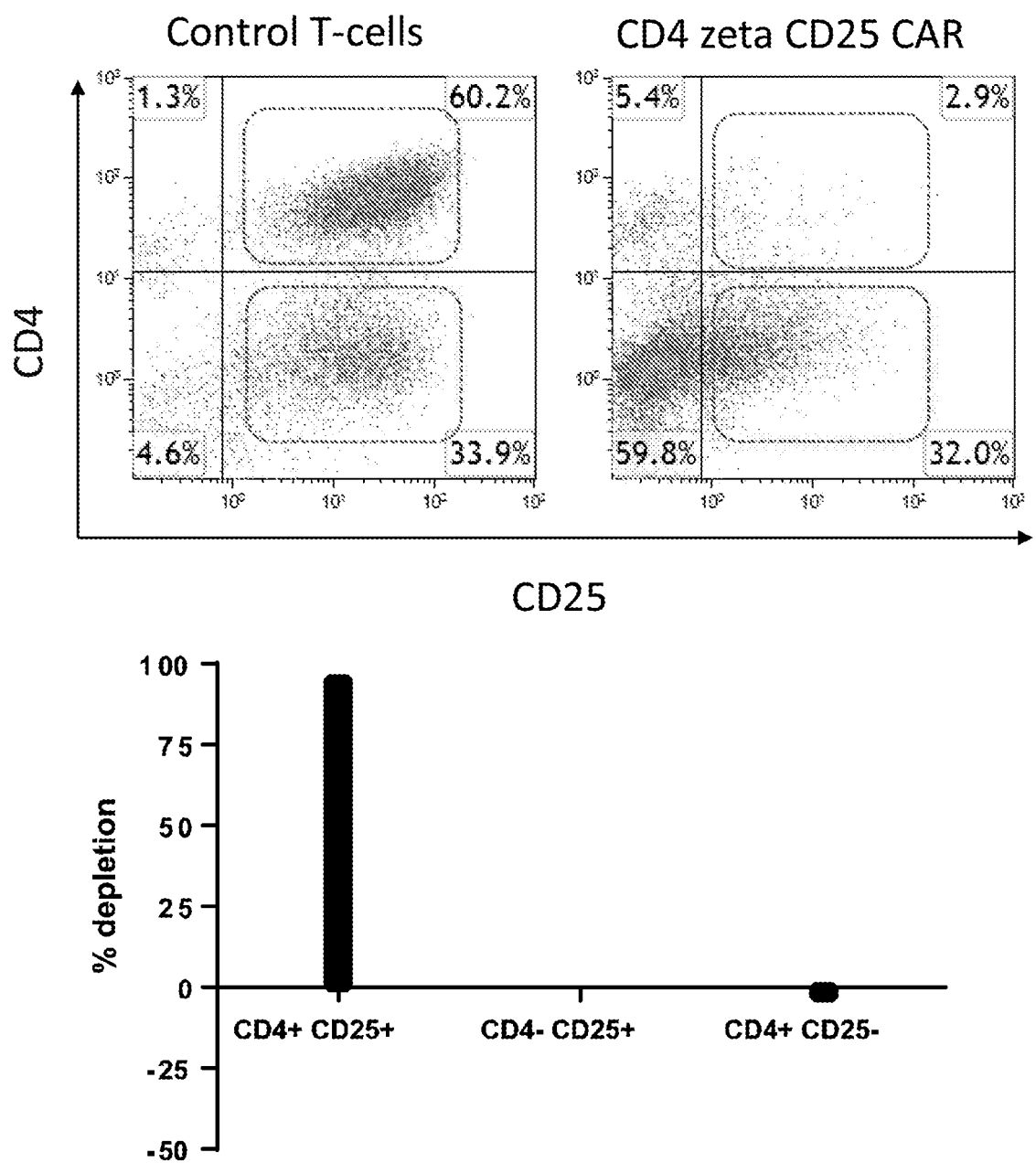

FIGS. 71A-71B. Characterization of the CD4 zeta CD25 CAR. (71A) The CD4 zeta CD25 CAR was transduced into T-cells via viral incubation for 48 hours and stained with F(ab)' antibody to assay CAR surface expression. Encircled populations represent transduced cells. (71B) The C4-25z CAR (CD4 zeta CD25 CAR, Treg CAR) was characterized using CD4 and CD25 antibodies to validate the construct function. Two most relevant populations are encircled: $CD4^+ CD25^+$ and $CD4^- CD25^+$. The depletion of the double positive population and other phenotype groups are summarized in the bar graph adjacent.

Figure 72:
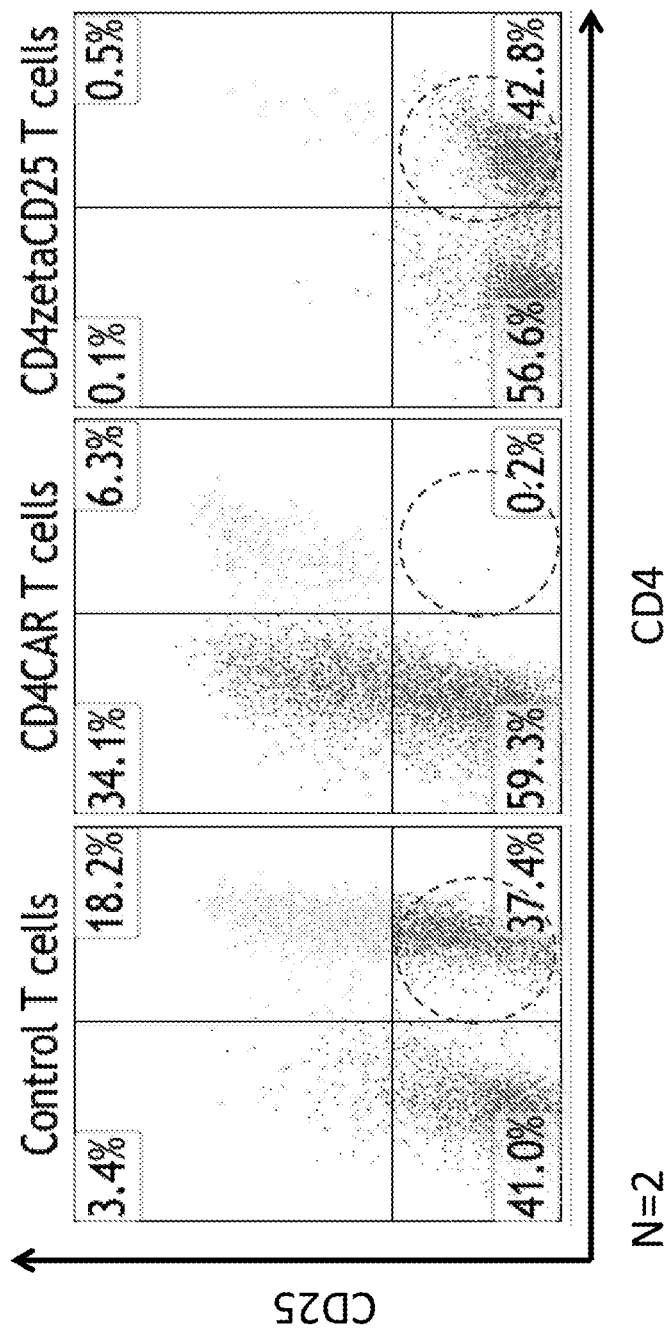

FIG. 72. CD4zetaCD25 CAR T cells target cells mainly co-expressing CD4 and CD25. 3 days after activation, PMBC buffy coat T cells transduced with either control vector (left), CD4CAR (middle) or CD4zetaCD25(right) lentiviral supernatant were harvested and incubated with mouse anti-human CD25-PE and mouse anti-human CD4-APC for 30 minutes. Cells were washed and suspended in 2% formalin, and analyzed by flow cytometry.

Figure 73A:
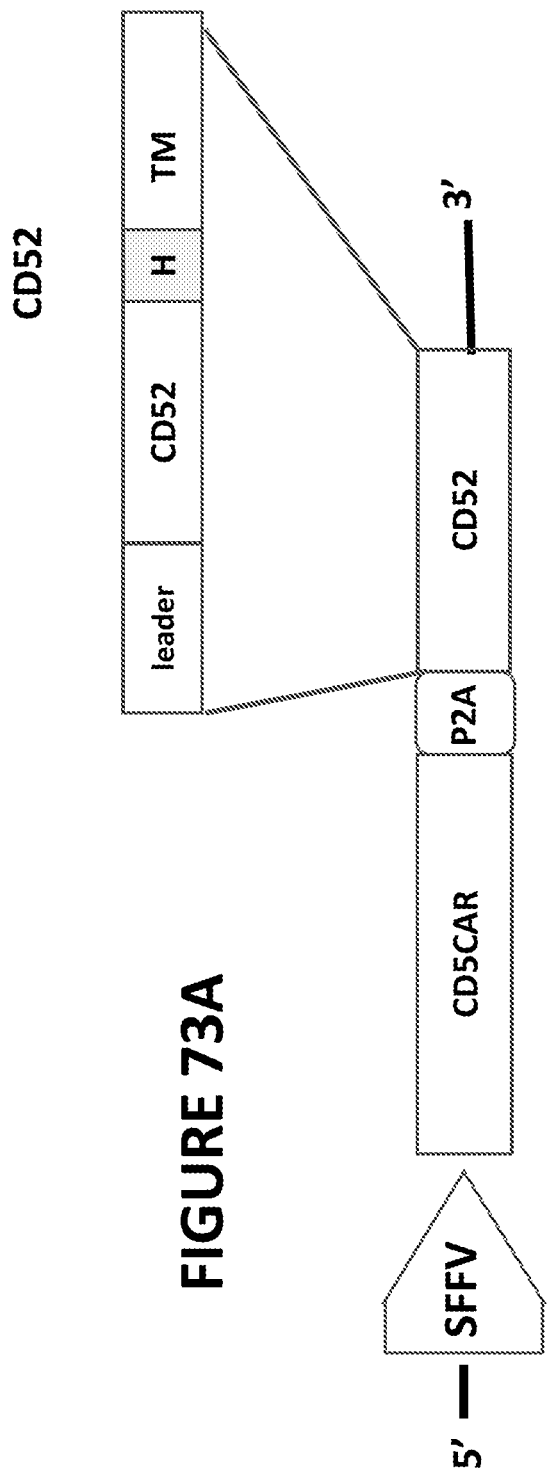

FIG. 73A. A schematic showing the CD5CAR-52 construct. The construct consists of a SFFV promoter driving the co-expression of CD5CAR and CD52 surface antigen. Upon cleavage of the linker of P2A. The CD5 chimeric antigen receptor polypeptide unit comprises a signal peptide, a CD5 antigen recognition domain, a hinge region, a transmembrane domain, a co-stimulatory domain of CD28, and CD3 zeta chain; CD5 peptide comprises a signal peptide, a CD52 antigen recognition domain (anti-CD52 scFv), a hinge region, a transmembrane domain (derived from CD28).

Figure 73B:
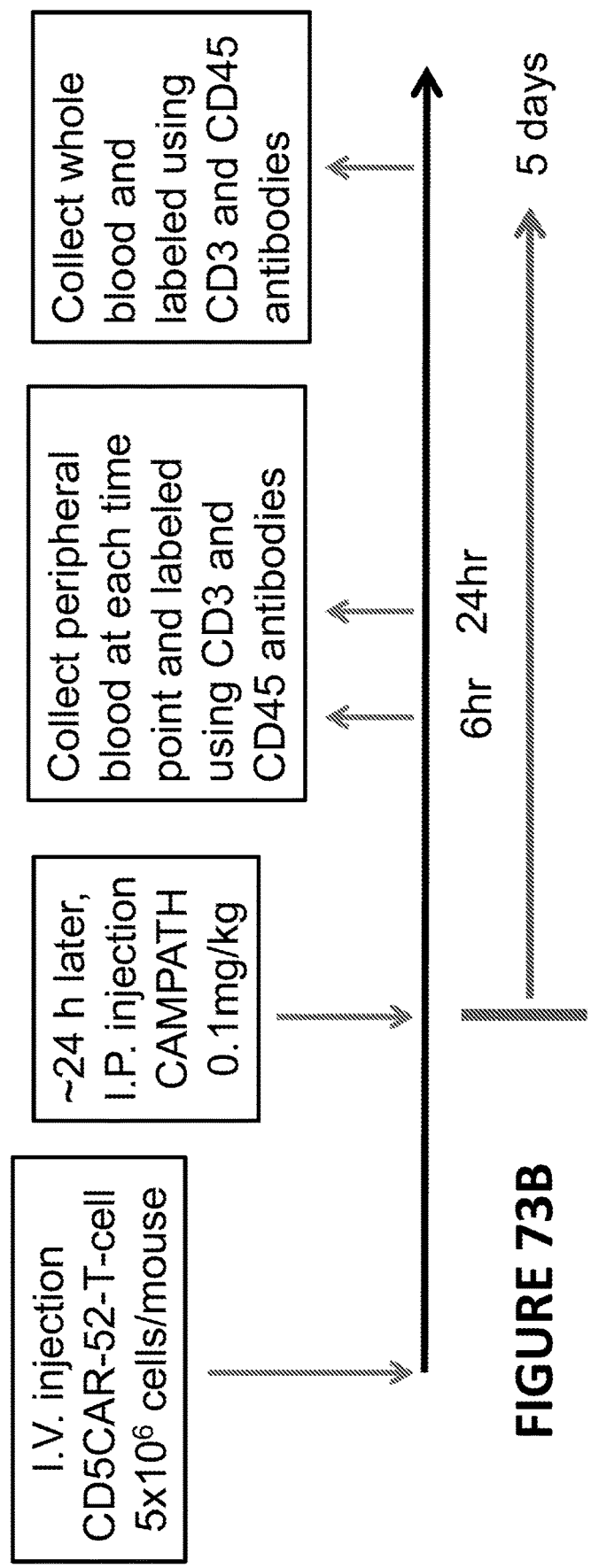

FIG. 73B. Experimental design to determine depletion of CD5CAR-52 T cells in blood. CD5CAR-52 T cells ($5 \times 10^6$ cells) were injected intravenously into each NSG mouse after sublethally irradiation. After ~24 h later, PBS or 0.1 mg/kg of CAMPATH was injected via I.P. (intraperitoneal injection). N=3. After 6 h and 24 h later, peripheral blood was collected from each mouse and labeled using CD3 and CD45 antibodies to determine the depletion of CAR-T cells as acute phase response by CAMPATH treatment. After 5 days, whole blood was collected from each mouse and labeled using CD3 and CD45 antibodies to determine the persistency of CAR-T cells as well. CAR-T-cells were determined using Flow cytometry analysis.

Figure 73C:
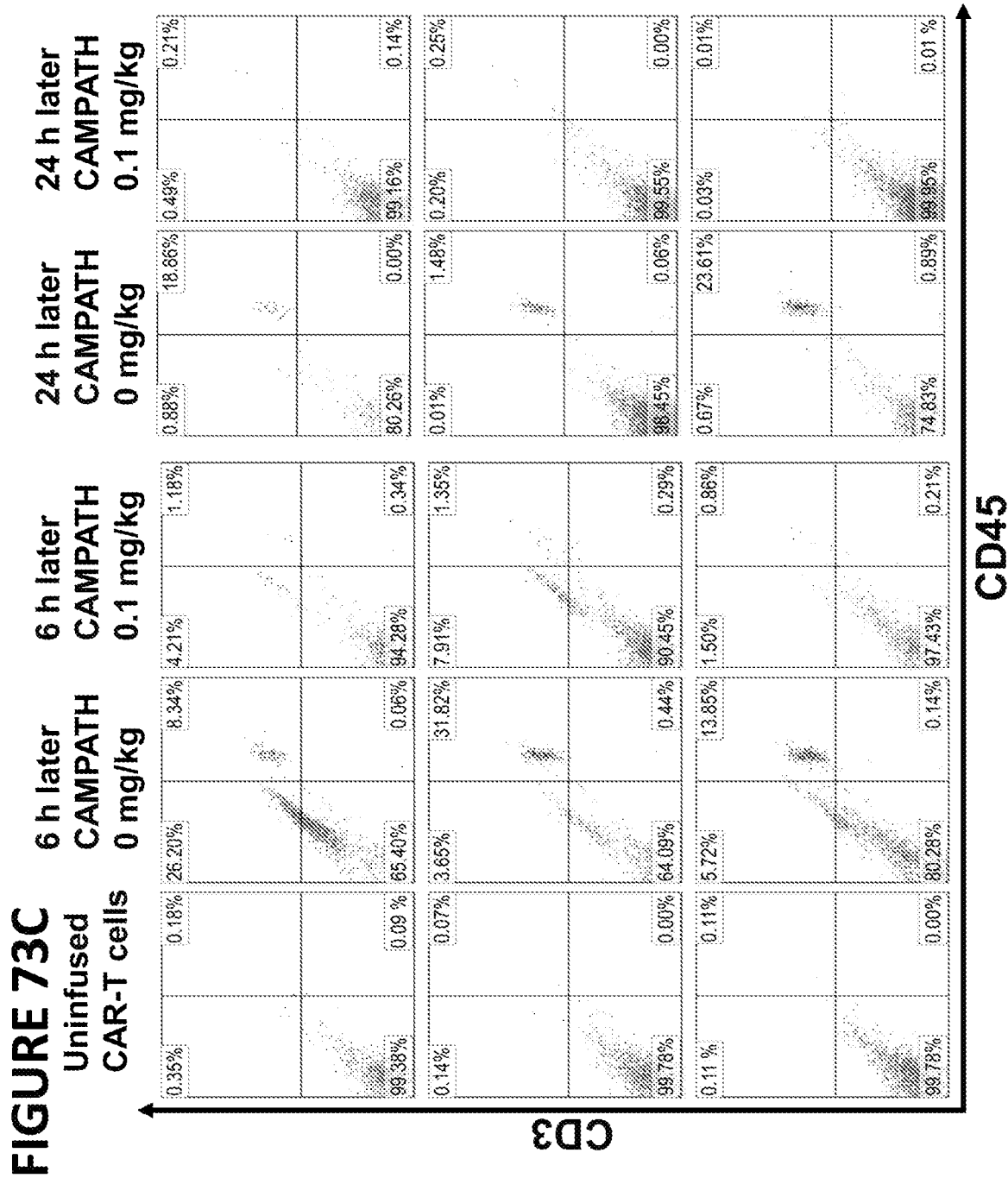

FIG. 73C. Depletion of CD5CAR-52 T in peripheral blood after 6 h and 24 h later with or without CAMPATH treatment. Flow cytometry analysis shows persistence of CD5CAR-52 T-cells (Blue dots) in peripheral blood of mouse with or without CAMPATH treatment. Blood samples were labeled with CD3 and CD45 antibodies to detect CD5CAR-52 T-cells. Blood samples from un-infused CAR-T cells (left panels) did not show CD3 and CD45 positive cells (negative control). 0.1 mg/kg of CAMPATH injected mice indicate elimination of CD5CAR-52 T-cells at 6h (middle panels) and 24 h (right panels) later compared to CAMPATH untreated mouse at 6h (second panels from left) and 24 h (second panels from right) in blood samples. N=3. These results suggest that CAMPATH treatment can delete CAR-T cells from blood during short time.

Figure 73D:
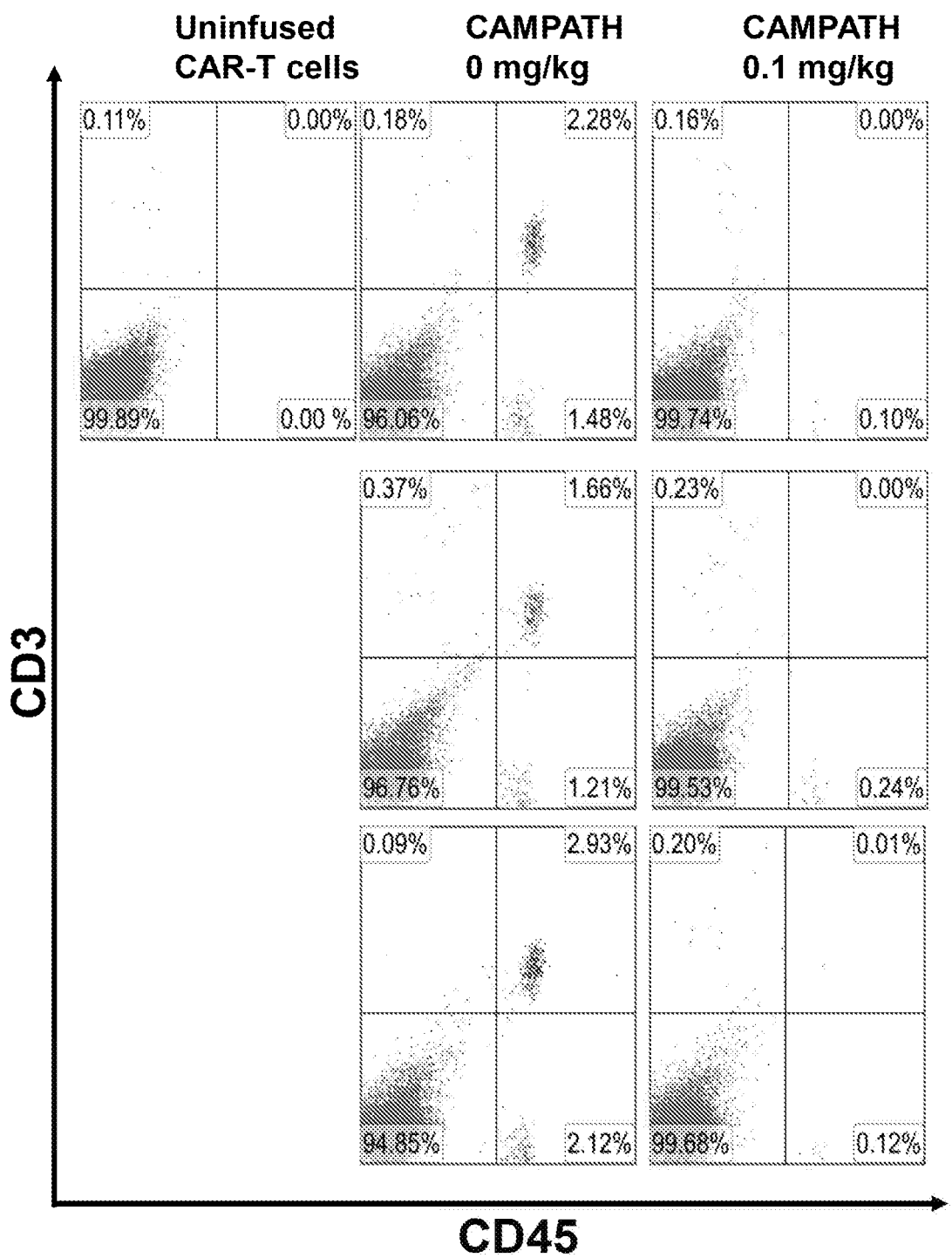

FIG. 73D. Depletion of CD5CAR-52 T in whole blood after 5 days with or without CAMPATH treatment. Flow cytometry analysis shows persistence of CD5CAR-52 T-cells (Blue dots) in whole blood samples from mouse with or without CAMPATH treatment. Blood samples were labeled with CD3 and CD45 antibodies to detect CD5CAR-52 T-cells persistence. Blood samples from uninfused CAR-T cells (left panel) did not show CD3 and CD45 positive cells (negative control). 0.1 mg/kg of CAMPATH treated mice eliminate CD5CAR-52 T-cells (right panels) compared to CAMPATH uninjected mouse (middle panels) after 5 days in whole blood samples. These results also suppose CAMPAT treatment can delete CAR-T cells from blood.

FIG. 74. HEK 293 cells were transduced with either EF1-GFP or SFFV-GFP viral supernatant, using the volumes indicated, in DMEM with 10% FBS in a 6 well tissue culture plate. Culture media was changed the following morning. Forty-eight hours later, transduced cells were visualized on an EVOS fluorescent microscope using GFP at 10×.

Figure 75:
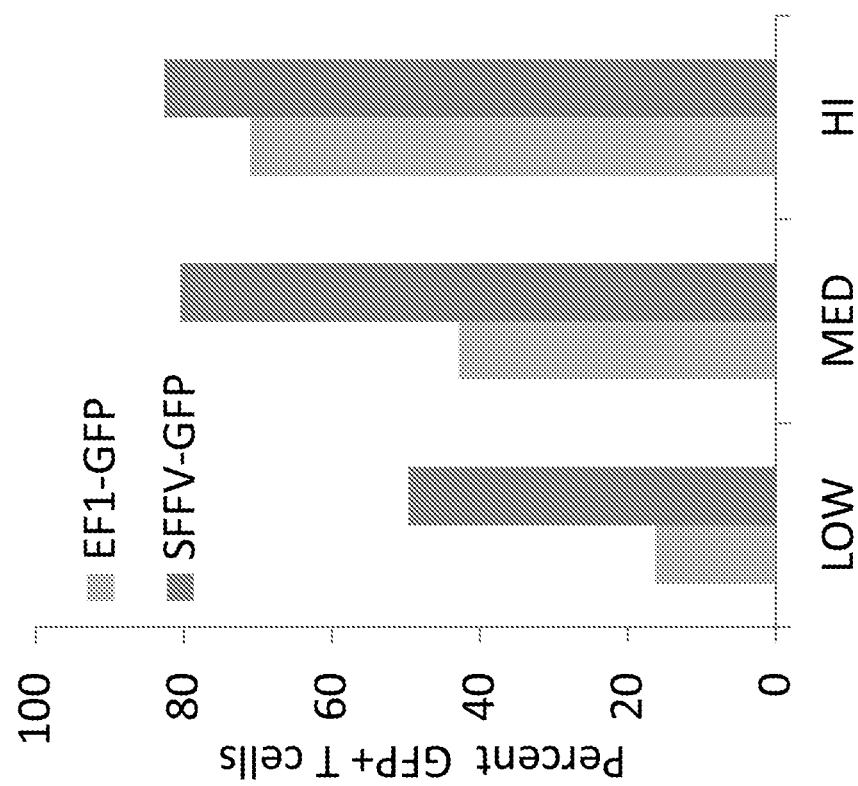

FIG. 75. HEK 293 cells transduced with either EF1-GFP or SFFV-GFP viral supernatant, using the volumes from the previous figure, were trypsinized, suspended in formalin, and subjected to flow cytometry analysis, using the FITC channel to determine the percentage of GFP+ cells.

Figure 76B:
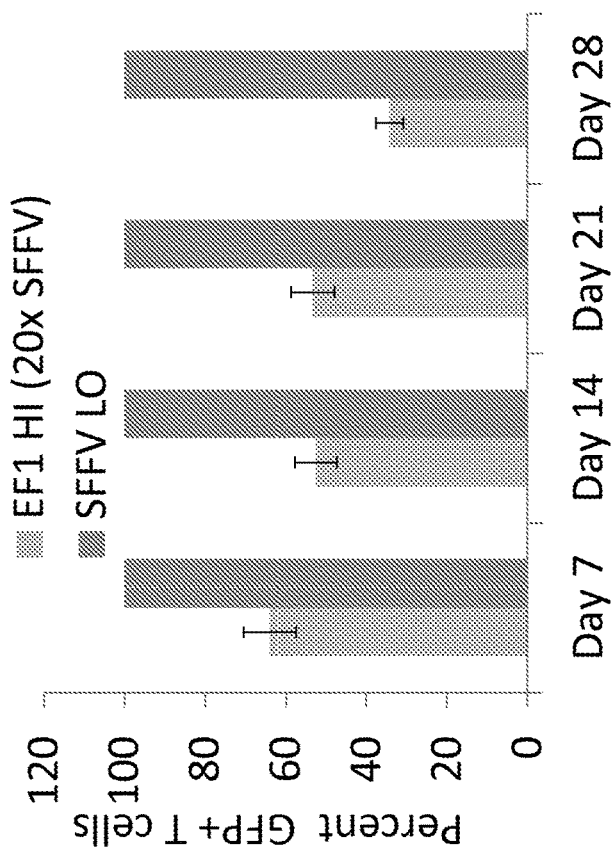
Figure 76A:
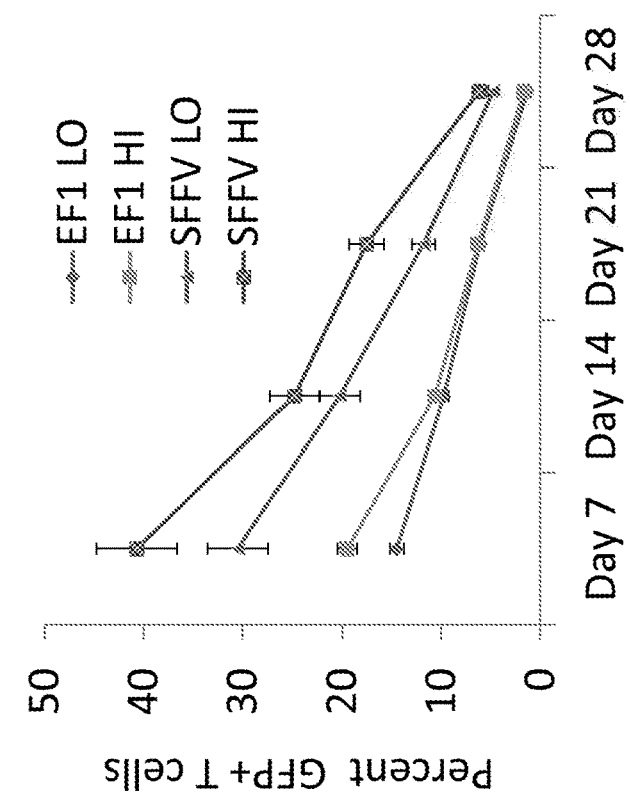

FIGS. 76A-76B. Activated cord blood buffy coat T cells transduced with either EF1-GFP or SFFV-GFP viral supernatant, with either low or high amounts of viral supernatant, were trypsinized, suspended in formalin, and subjected to flow cytometry analysis, using the FITC channel to determine the percentage of GFP+ cells, 7, 14, 21 and 28 days after transduction. (76A) Percent GFP+ T cells for cells transduced with either low or high amounts of supernatant. (76B) Percent of GFP+ T cells transduced with the high amount of EF1-GFP supernatant, relative to the percent GFP+ cells in the T cells transduced with the lower amount of SFFV-GFP supernatant. (50 μL of SFFV-GFP and 1 mL of EF1-GFP supernatant was used). (N=2).

Figure 77:
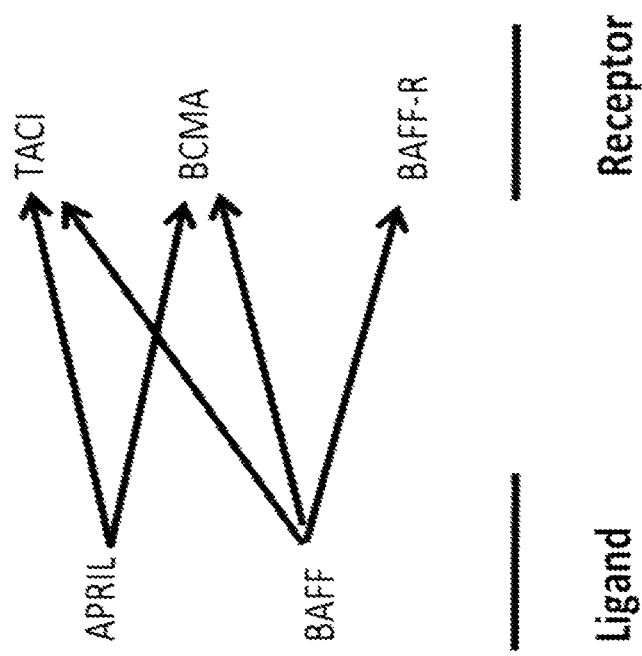

FIG. 77. Ligand receptor interactions in malignant plasma cells. The APRIL ligand binds TAC1 or BCMA. The BAFF ligand binds TAC1, BCMA, or BAFF-R.

FIGS. 78A-78B. Steps for elimination of tumor by CAR co-expressing secretory IL-15/IL-15sushi. 78A, tumor and its microenvironment. Macrophages, T cells, dendritic cells and NK cells are immune response cells against tumor in the tumor microenvironment and they secrete a low level of endogenous IL-15, which is unstable, which complexes with the soluble extracellular domain of IL-15RA. The complex forms a more stable molecule, which greatly enhances immune cell survival and expansion. In the tumor microenvironment, cancer cells express programmed death ligand 1 (PD-L1) as a transmembrane protein that has been considered to play a major role in suppressing the immune system during particular events including cancer. PD-L1 binds to its receptor, PD-1, found on activated T cells, B cells, and myeloid cells, to suppress these cell immune activities. 78B, CAR T or NK cells targeting tumor cells, could be a carrier to deliver an enhancer to the tumor microenvironment. CAR T or NK cells are engineered to co-express a secretory fusion protein, IL-15/IL-15sushi fusion. 78C, Engineered CAR T or NK cells bind to targeted tumor cells (either subset or all cells). 78D, Engineered CAR T or NK cells in tumor microenvironment target tumor cells, binding to the CAR targeting antigen, and triggering lysis of tumor cells and massive secretion of soluble IL-15/IL-15sushi fusion from the expansion of CAR T or NK cells. The soluble IL-15/IL-15sushi fusion are stable and functions as an unexpected and powerful immunomodulatory for CAR T/NK cells and their neighbor tumor immune response cells. The secreted IL-15/IL-15sushi protein would be involved in trafficking of other T cells, dendritic cells, macrophages and NK cells to the tumor microenvironment, which then also: 1) lyse the tumor cells by supplementing the defect that CAR T or NK cells are unable to eliminate non-targeting cancer cells; 2) enhance CAR T/NK cell persistency and anti-tumor activity. The overexpression of IL-15/IL-15sushi overwhelms the PD-L1 ability to suppress the immune response. Preferably, this CAR therapy could be used synergistically with administration of a checkpoint blockage including, but not limited to PD-L1, CTLA-4 inhibitor for even greater efficacy.

Figure 79:
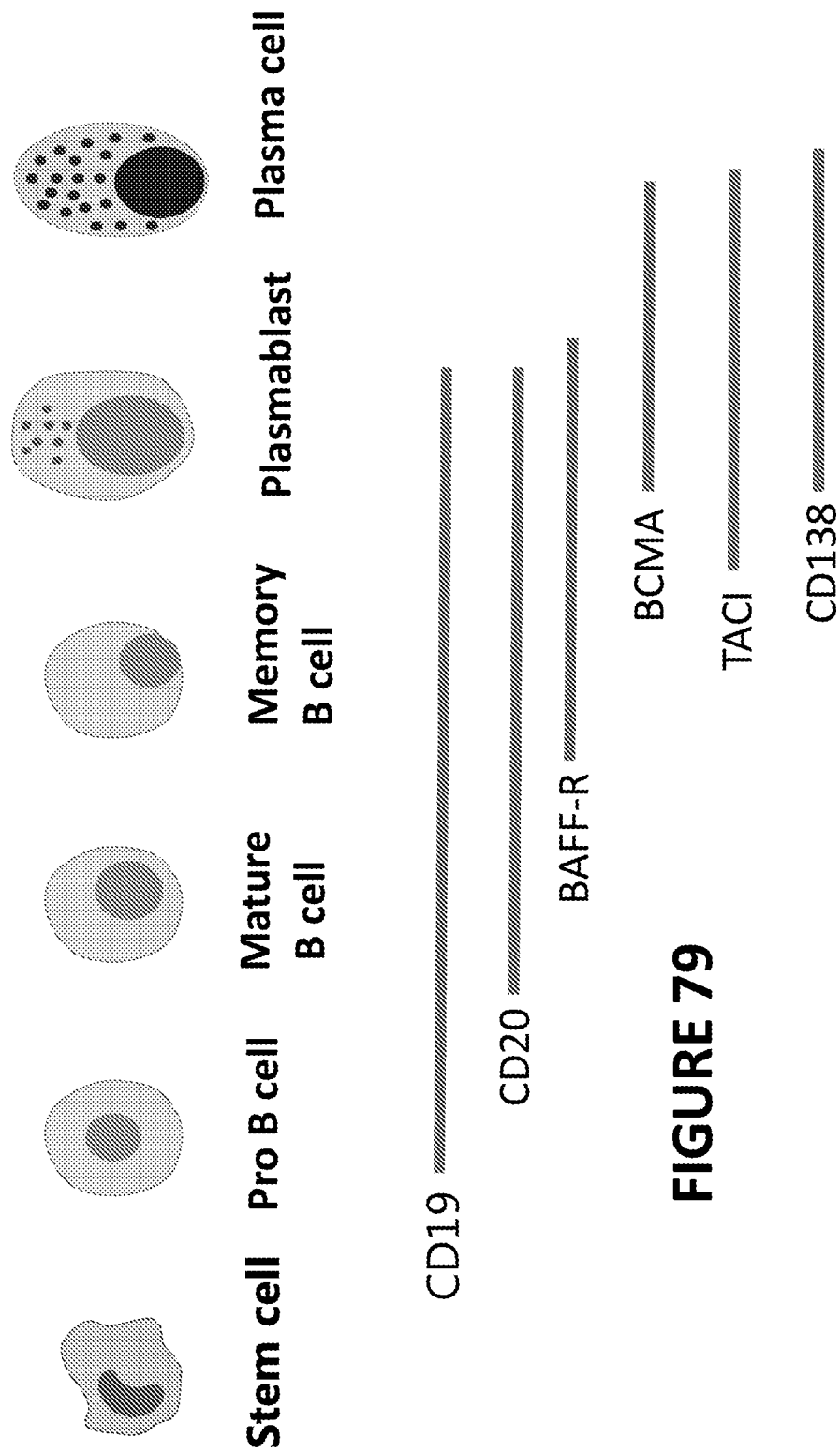

FIG. 79. Surface markers during B cell and plasma cell development are shown. Both BAFF and APRIL binds to receptors, BCMA and TACI. BAFF also binds to BAFF-R receptor.

FIG. 80. Protein sequence alignment of IL-2 signal peptide among different species.

Figure 81:
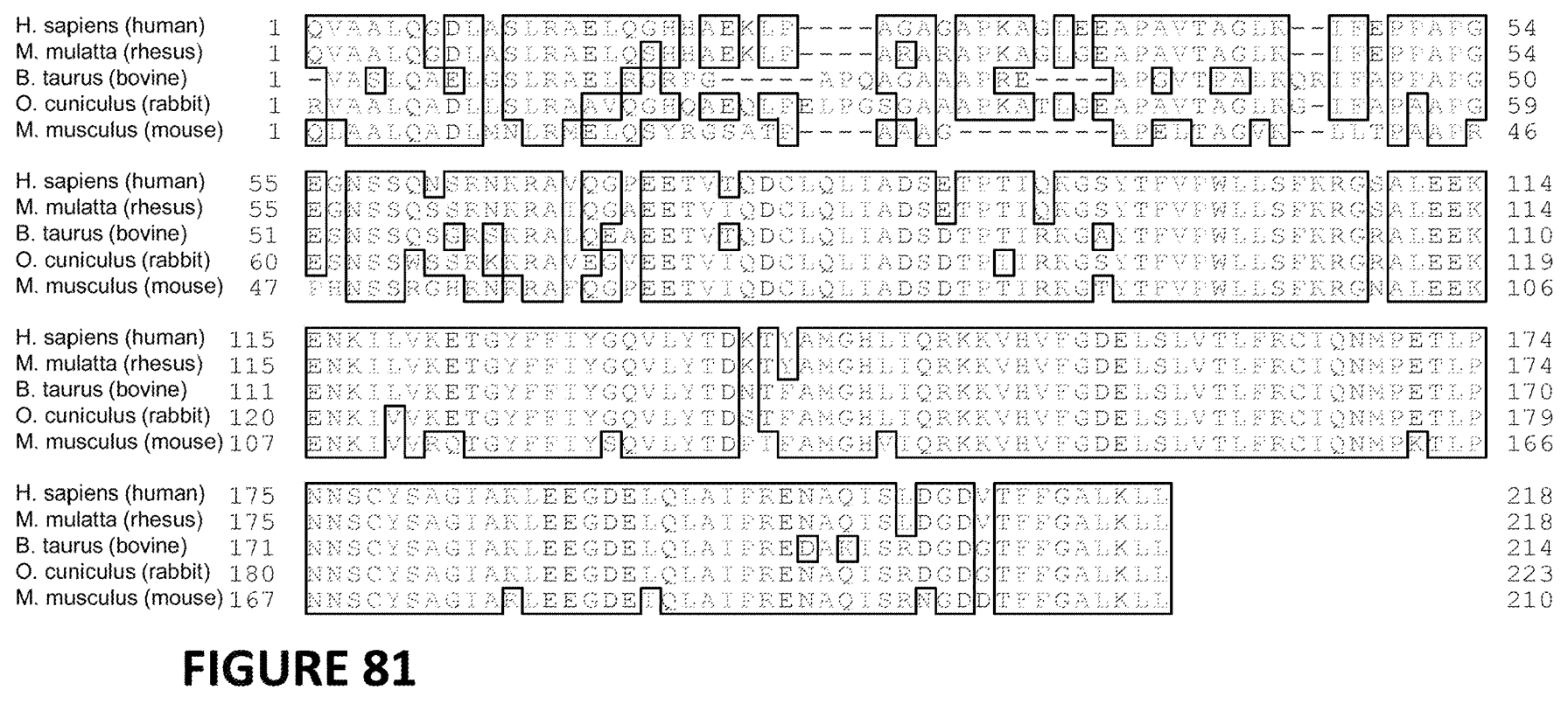

FIG. 81. Protein sequence alignment of BAFF extracellular domain among different species.

Figure 82A:
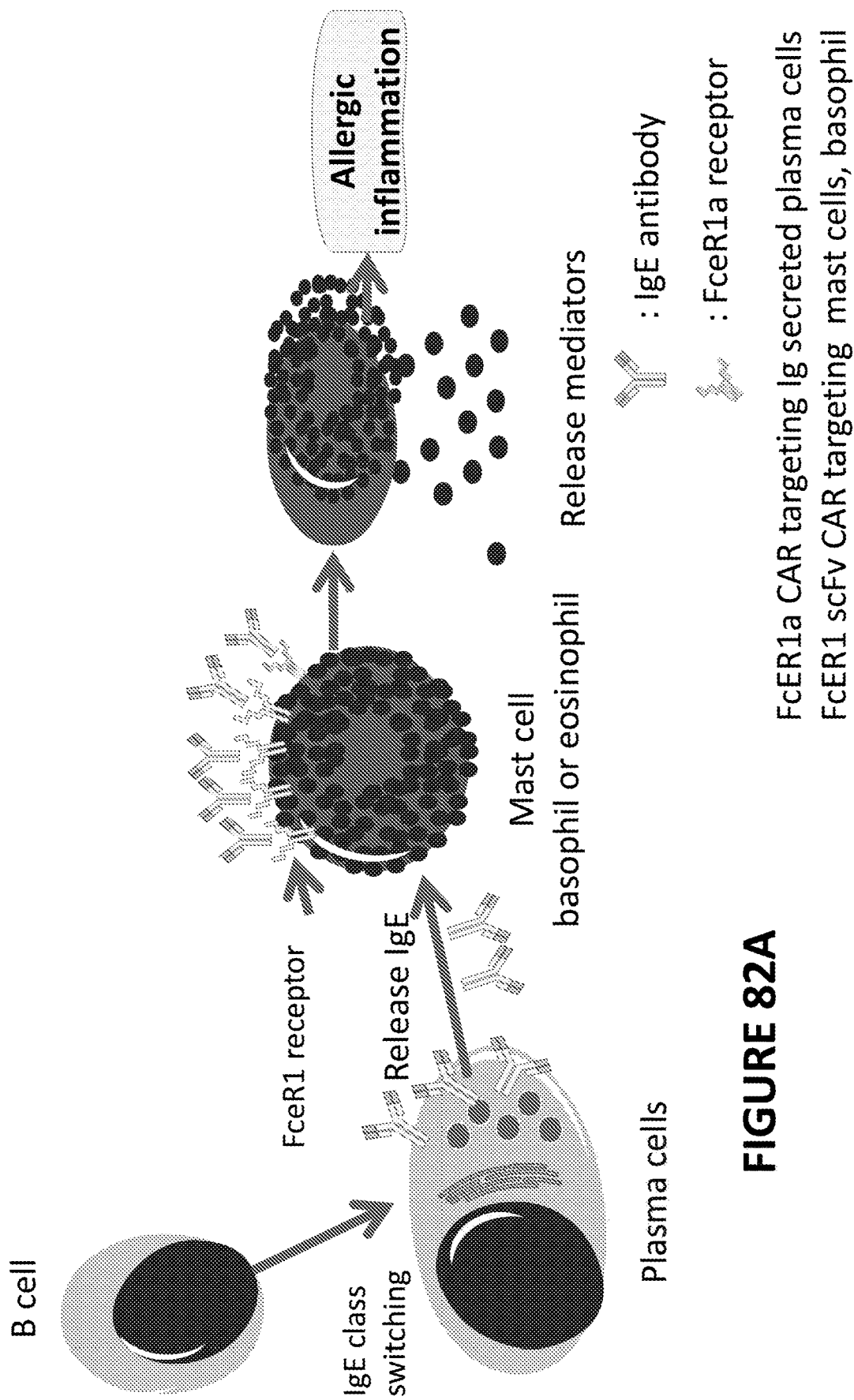

FIG. 82A. Model of Ig E production and allergic inflammation. IgE antibody is generated initially from activated B cells and differentiation into IgE plasma cells. IgE releases from plasma cells and binds to a FceR1 receptor complex present in the mast cells, basophil or eosinophil, which then triggers the release of allergic mediators. A CAR can be designed to target or delete the IgE producing plasma cells and basophils or eosinophils responsible for allergic mediator releases.

FIG. 82B. Organization of the FcER1A CAR construct. The FcER1A CAR construct includes a leader sequence, an extracellular domain of FcER1A, a hinge domain (H), a transmembrane domain (TM), a co-stimulatory domain (including, but not limited to, CD28 or 4-1BB) and the intracellular signaling domain CD3 zeta.

Figure 82C:
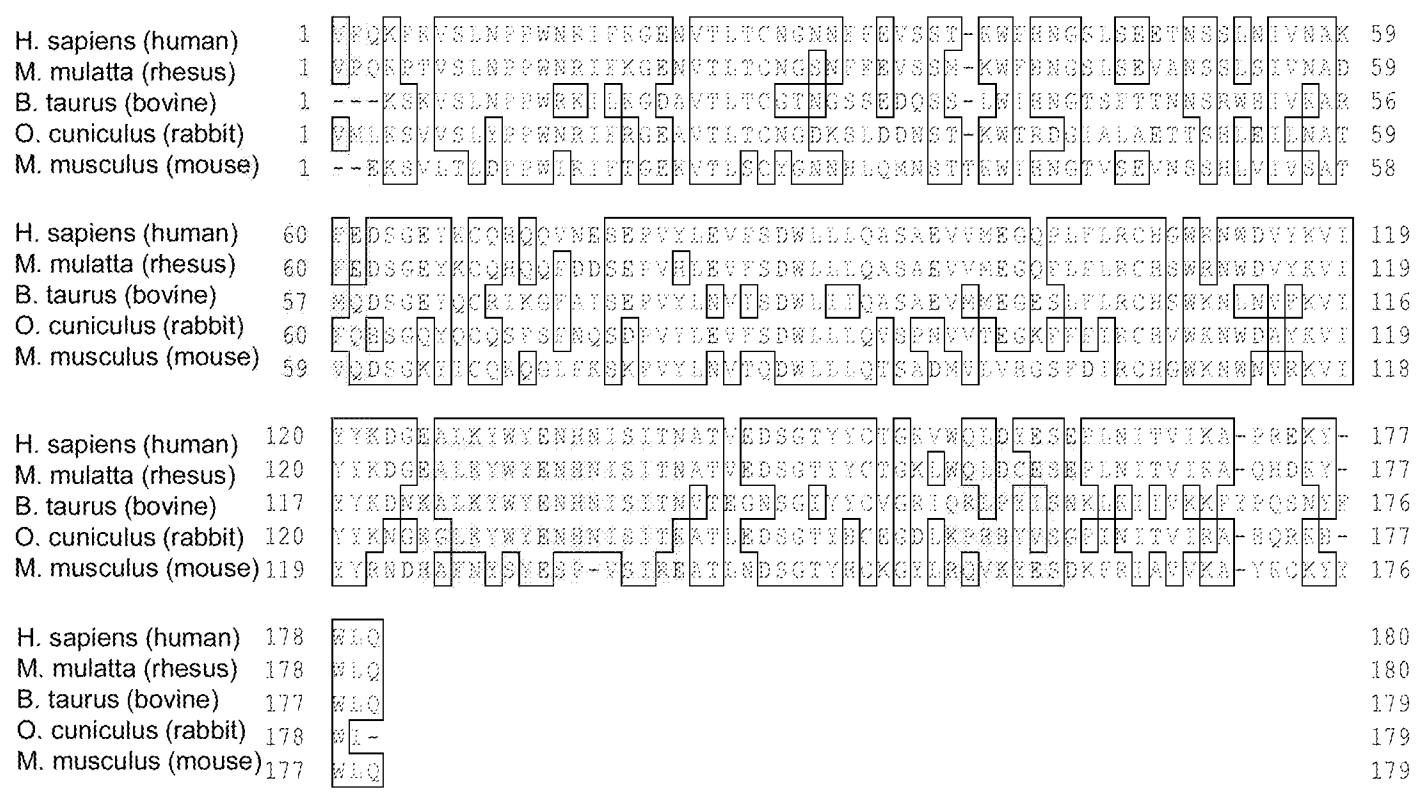

FIG. 82C. Protein sequence alignment of FcER1A extracellular domain among different species. The target may include a portion of the surface exposed regions of FcER1A.

Figure 82D:
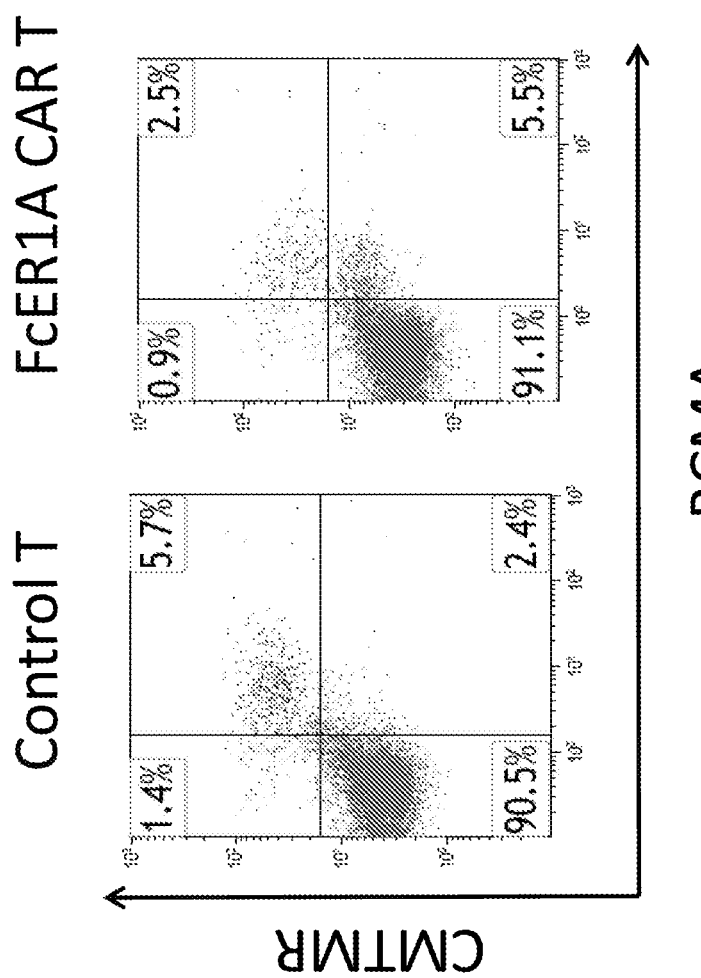

FIG. 82D. FcER1A CAR targets and lyses IgE producing cells, U266 plasma cells. Control and FcER1A CAR T-cells were incubated with a myeloma cell line—U266 (prestained with Celltracker CMTMR), that is strictly positive for BCMA at an E:T ratio of 5:1. Co-cultures were setup with 48 hour incubation times and flow cytometry acquisition with CD3 and BCMA antibodies for analysis. Blue populations represent BCMA+U266 cells.

Figure 82E:
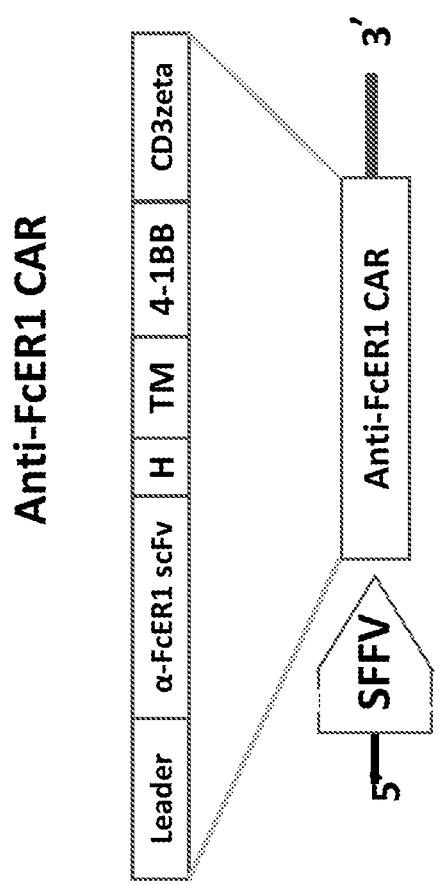

FIG. 82E. Organization of anti-FcER1A or FcER1 complex CAR construct. The FcER1A or FcER1 complex CAR construct includes of a leader sequence, scFv against FcER1A or FcER1 complex, a hinge domain (H), a transmembrane domain (TM), a co-stimulatory domain (including, but not limited to, CD28 or 4-1BB) and the intracellular signaling domain CD3 zeta.

Figure 83A:
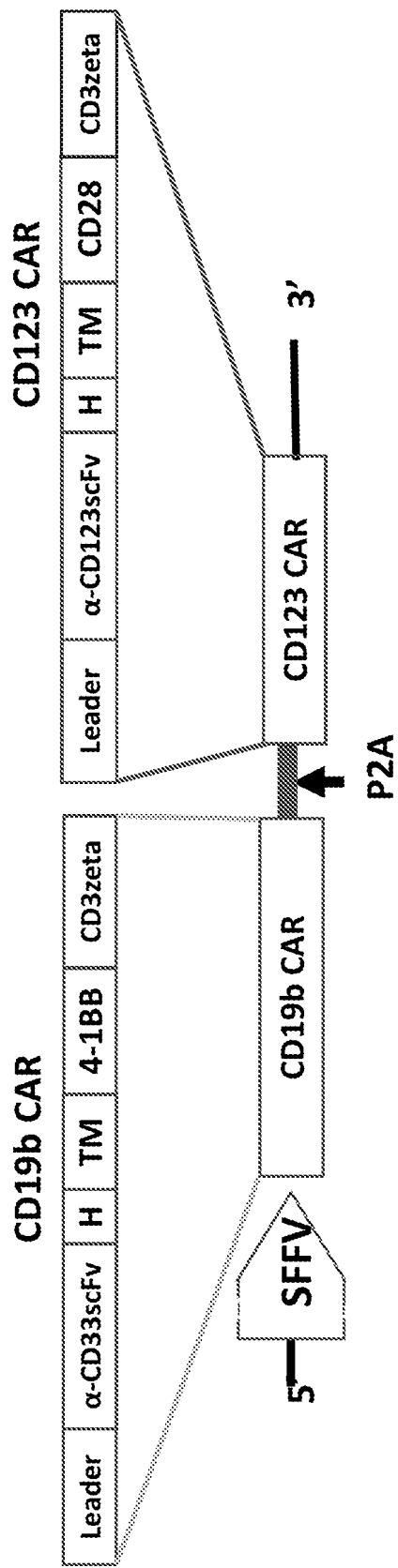

FIG. 83A. A schematic representation of cCAR construct. The construct includes a SFFV promoter driving the expression of multiple modular units of CARs linked by a P2A cleavage peptide. Upon cleavage of the P2A linker, the cCARs split and engage upon targets expressing CD19 and/or CD123. Each unit of CAR bears a scFv against the antigen, a hinge domain (H), a transmembrane domain (TM), a co-stimulatory domain (including, but not limited to, CD28 or 4-1BB) and the intracellular signaling domain CD3 zeta chain. As a novel cCAR construct, the activation domains of the construct may include, but is not limited to, 4-1BB on the CD19 CAR segment and a CD28 region on the CD123 CAR.

Figure 83B:
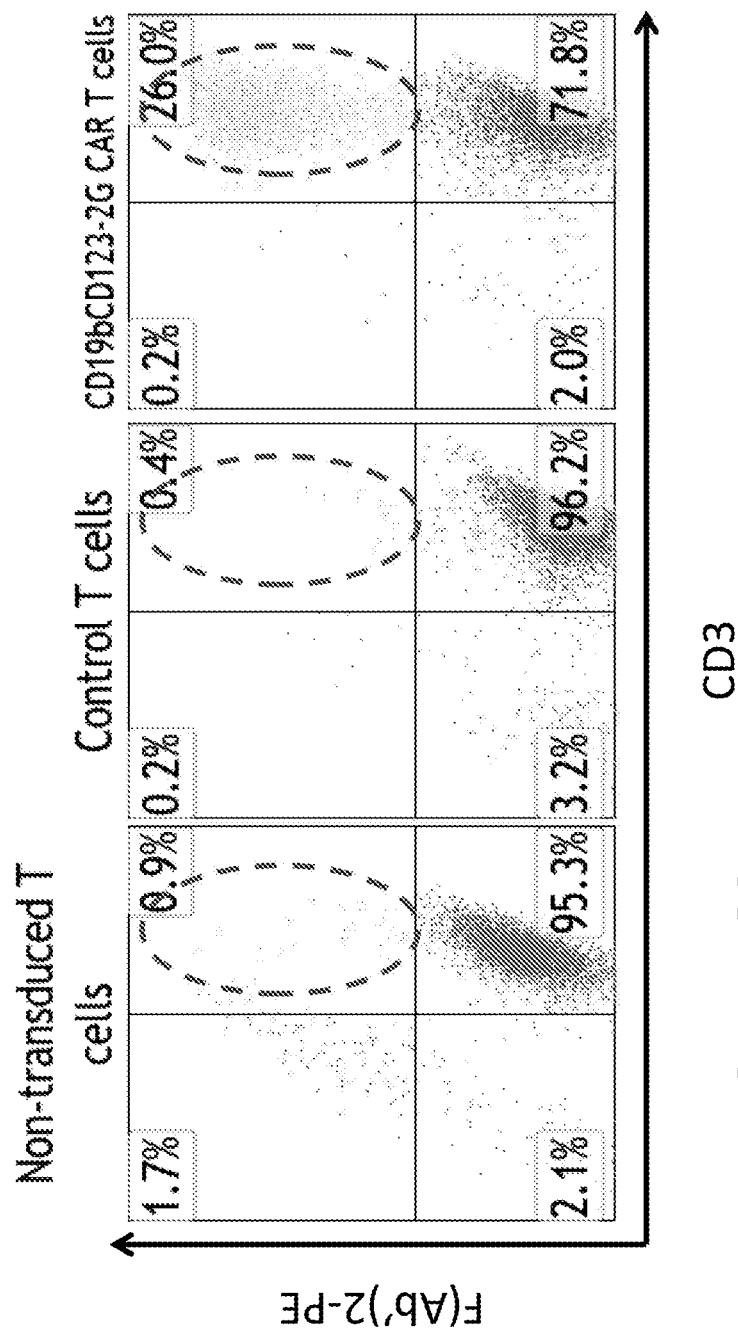

FIG. 83B. CAR expression: CD19b-123-2G. Peripheral blood mononuclear cells were transduced with either control vector (center) or CD19b CD123-2G (cCAR) CAR lentiviral vector (right). Forty-eight hours after recovery, cells were labeled with anti-mouse F(Ab')2-biotin antibody for detection of CAR phenotype. Activated T cells which were not transduced are shown on the left.

Figure 83C:
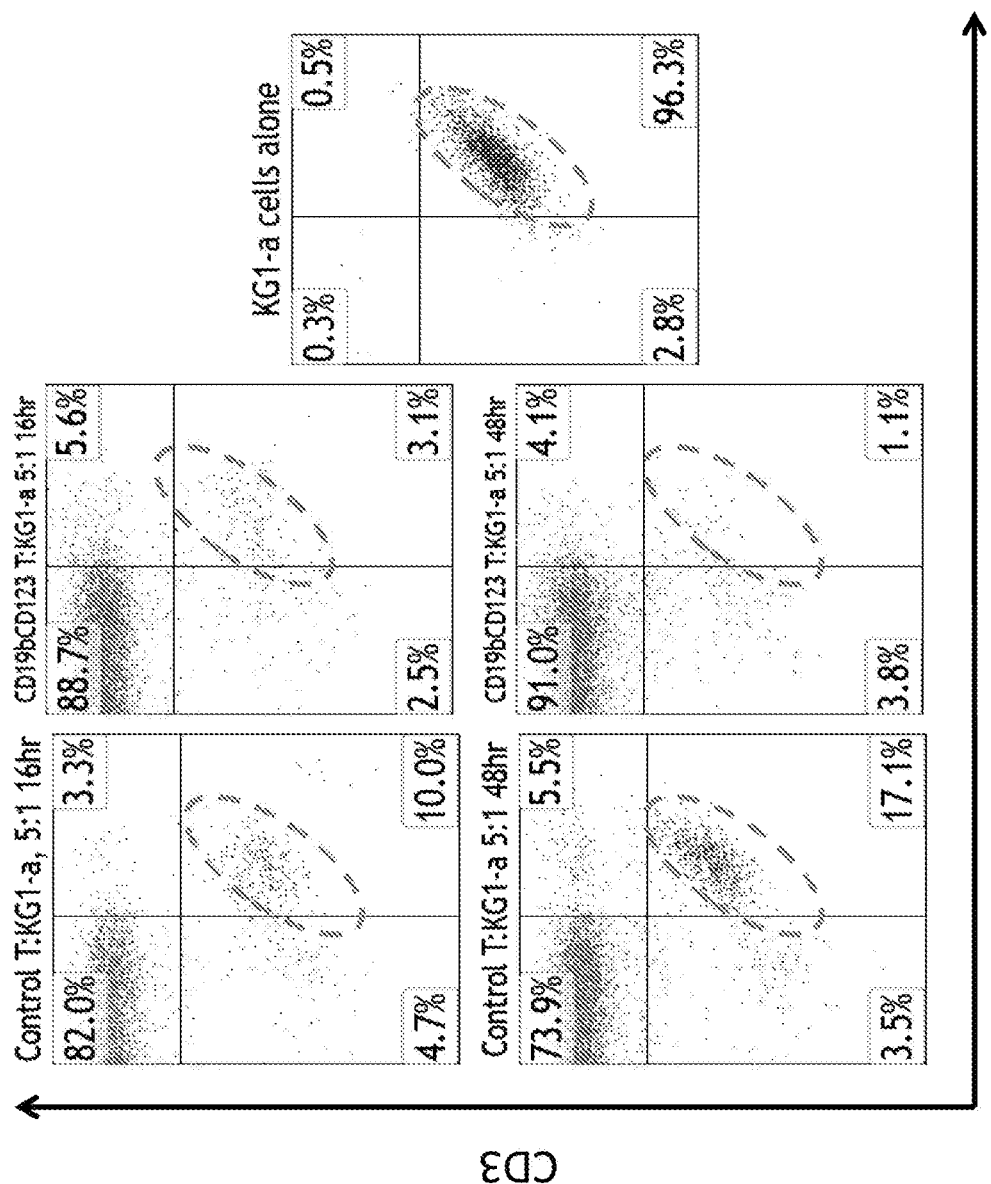

FIG. 83C. Co-culture: CD19bCD123 CAR T vs KG1-a, 16/48 hrs. CD19bCD123-2G cCAR can ablate CD123-expressing KG1-tumor cell lines in co-culture assays. Co-culture experiments were performed at an effector to target ratio of 5:1 for 16 hours and 48 hours and were directly analyzed by flow cytometry for mouse anti-human CD3pPerCp and mouse anti-human CD123-APC. Each assay includes target cells (KG1-a) vs control (left), cCAR (center), T cells, or target cells alone (right). N=2.

Figure 83D:
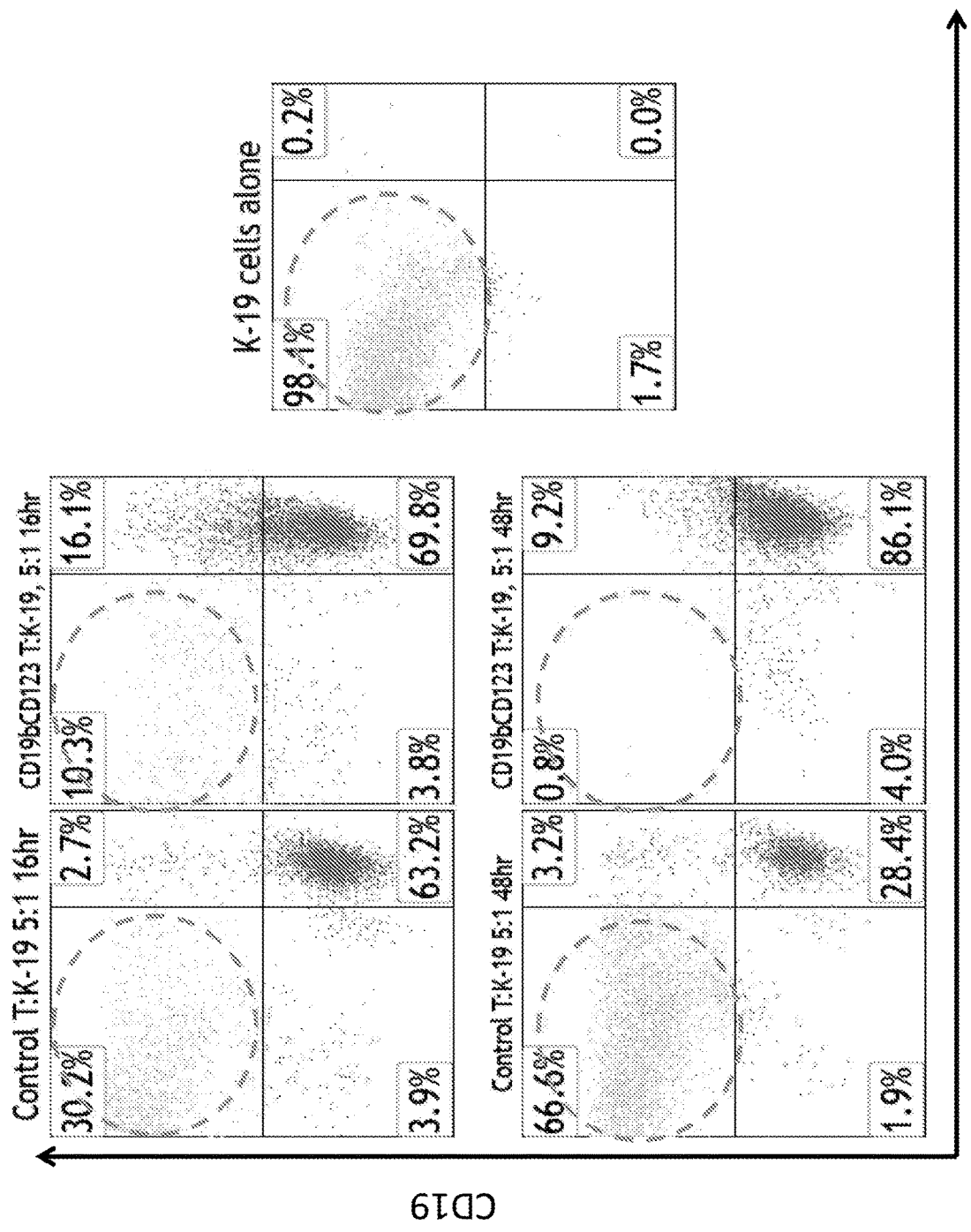

FIG. 83D. Co-culture: CD19bCD123 CAR T vs K562-CD19×p, 16/48 hrs. CD19bCD123-2G cCAR can eliminate CD19-expressing K562 tumor cell lines, in co-culture assays. Co-culture experiments were performed at an effector to target ratio of 5:1 for 16 hours and 48 hours and were directly analyzed by flow cytometry for mouse anti-human CD3pPerCp and mouse anti-human CD19-PE. Each assay includes target cells (K562 tumor cells artificially expressing CD19 antigen) vs control (left), cCAR (center), T cells, or target cells alone (right). N=2.

Figure 83E:
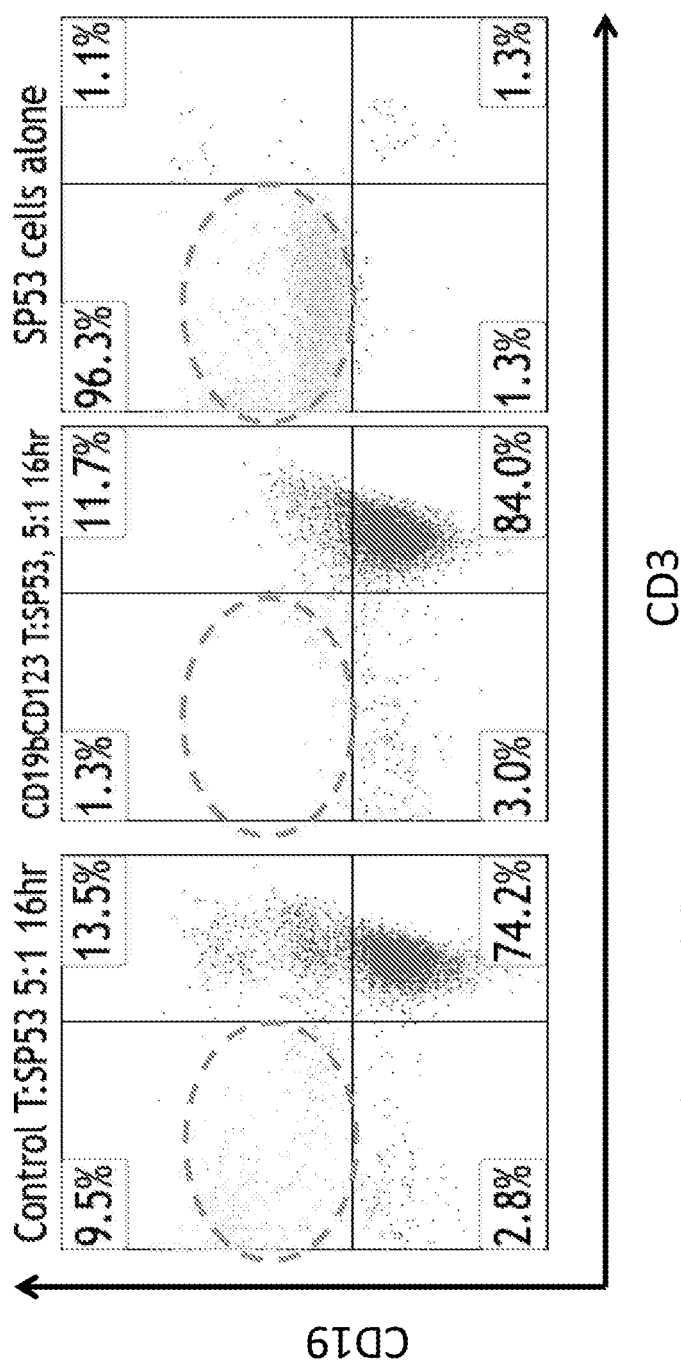

FIG. 83E. Co-culture: CD19bCD123 CAR T vs SP53, 16 hrs. CD19bCD123-2G cCAR is able to ablate CD19-expressing SP53 mantle cell lymphoma cell line, in co-culture assays. Co-culture experiments were performed at an effector to target ratio of 5:1 for 16 hours and were directly analyzed by flow cytometry for mouse anti-human CD3pPerCp and mouse anti-human CD19-PE. Each assay includes target cells (SP53) vs control (left), or cCAR (center), T cells, or target cells alone (right). N=2.

Figure 84A:
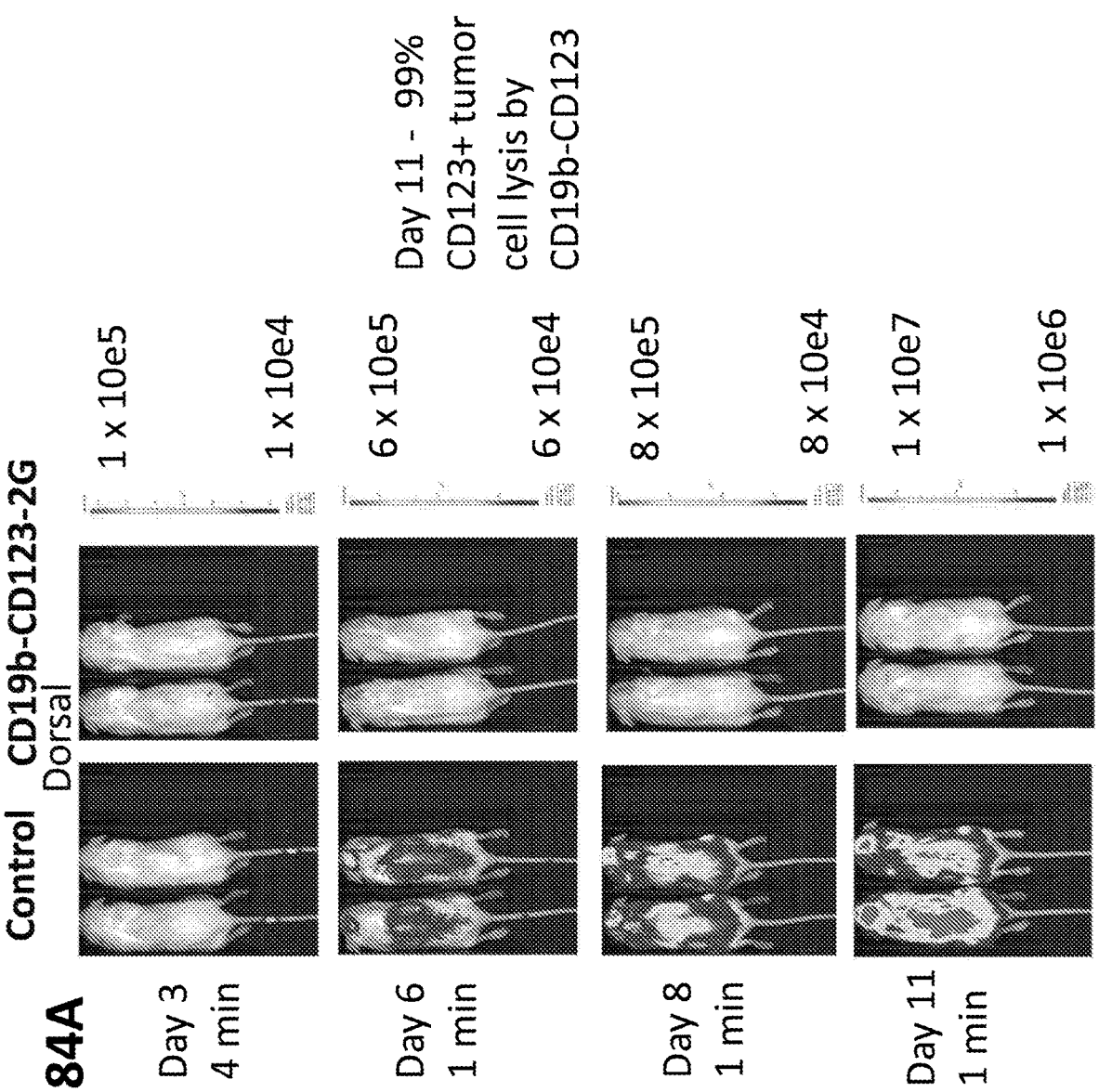

FIG. 84A. CD19b-CD123 cCAR mice are able to effectively control tumor growth in an AML tumor model. NSG mice were sublethally irradiated and, after 24 hours, intravenously injected $1 \times 10^6$ luciferase-expressing MOLM-13 cells (Day 1) to induce measurable tumor formation. Three days following tumor injection, mice were injected with $10 \times 10^6$ cells of either control or CD19b-CD123 CAR T-cells. On days 6, 8, and 11, mice were injected subcutaneously with RediJect D-Luciferin and subjected to IVIS imaging. Tumor intensity is quantified as luciferin signal (photons/sec).

Figure 84B:
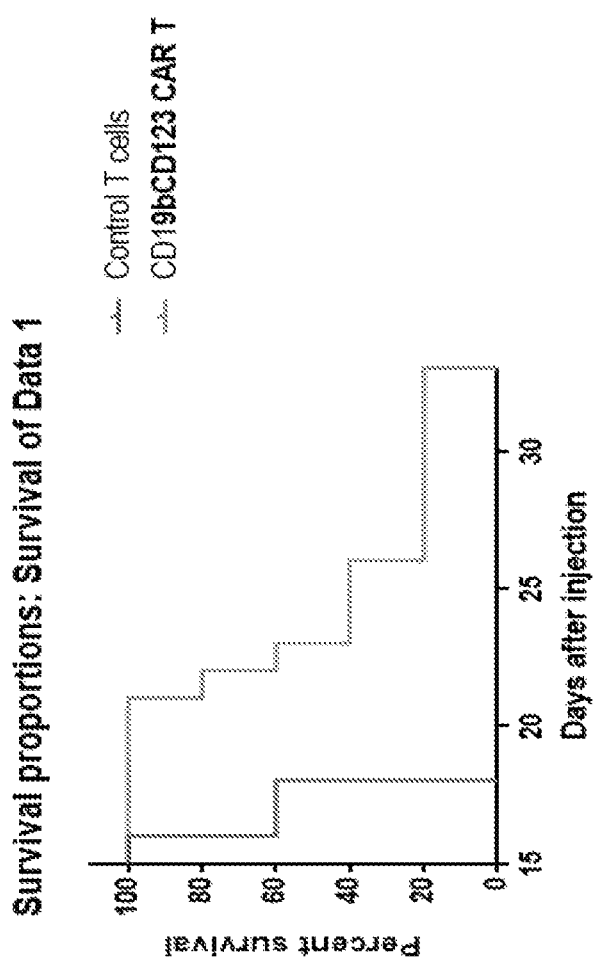

FIG. 84B. CD19bCD123 CAR T cells lyse MOLM13 tumor cells in vivo mouse model Survival curve. NSG mice injected with MOLM13 tumor cells survive significantly longer when treated with CD19b-CD123 CAR T cells. Ten sublethally irradiated NSG mice intravenously injected with MOLM13 cells to induce measurable tumor formation; half were intravenously injected three days later with CD19b-CD123 CAR T cells and the other half with vector control T control cells. Following the IVIS imaging experiments previously described, mice were observed every day for symptoms of severe illness, and were sacrificed once movement was greatly impaired. All control mice died by Day 18, while the CD19b-CD123 CAR T treated mice survived longer than control mice by up to 15 days (FIG. 84B). This difference between the groups was shown to be significant by the Mantel-Cox test (0.0031) and the Gehan-Breslow-Wilcoxon test (P=0.0043).

Figure 84C:
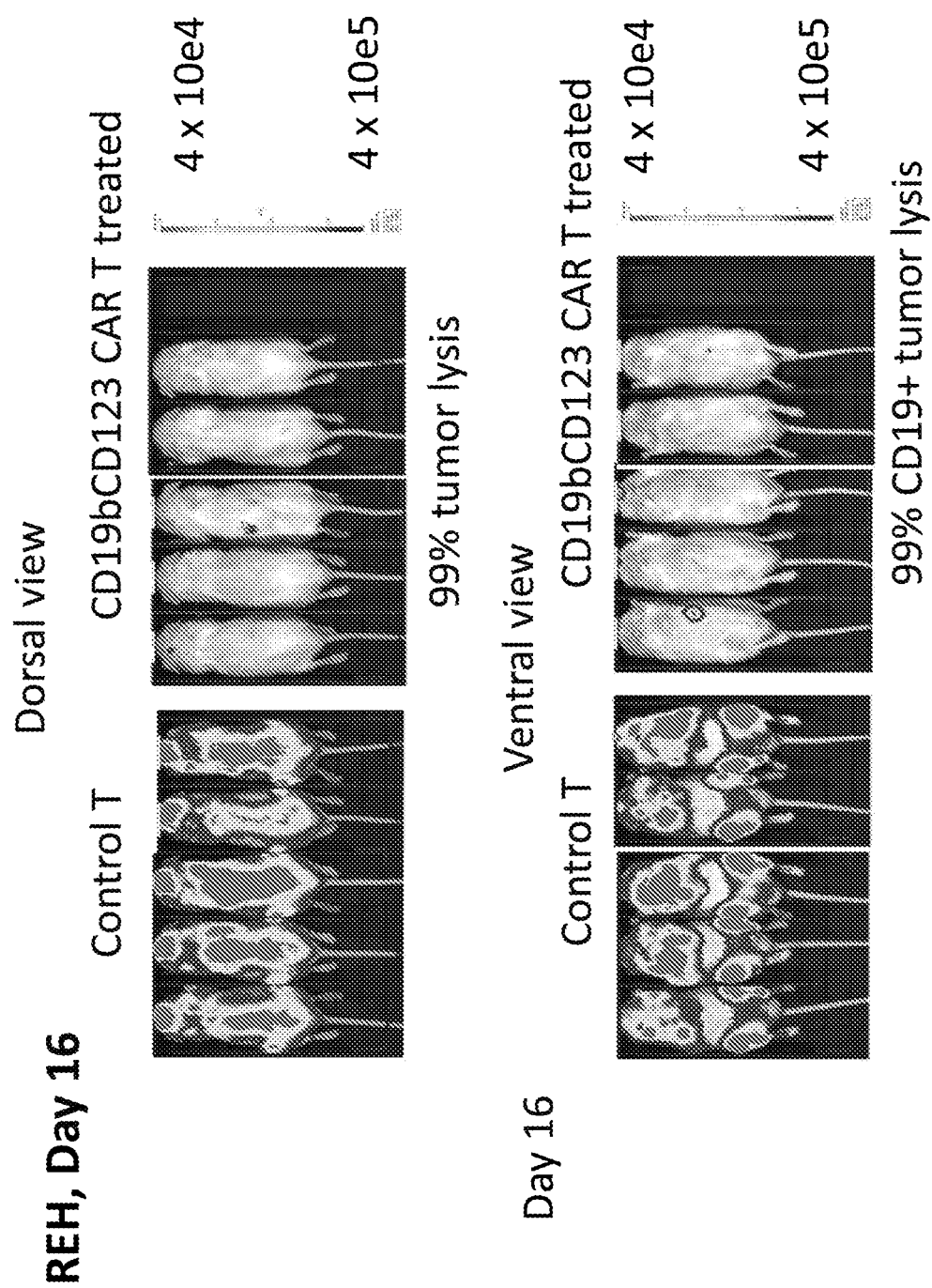

FIG. 84C. CD19bCD123 CAR T cells lyse REH tumor cells in vivo mouse model. CD19bCD123 CAR T cells demonstrate long-term anti-tumor effects in vivo. NSG mice were sublethally irradiated and intravenously injected with $1.0 \times 10^6$ luciferase-expressing REH cells (Day 0) to induce measurable tumor formation. Starting 3 days after injection of tumor cells, mice were intravenously injected with a course of $10 \times 10^6$ CD19bCD123 CAR T cells or vector control T cells. Mice were injected subcutaneously with RediJect D-Luciferin on Day 16 and subjected to IVIS imaging.

Figure 85A:
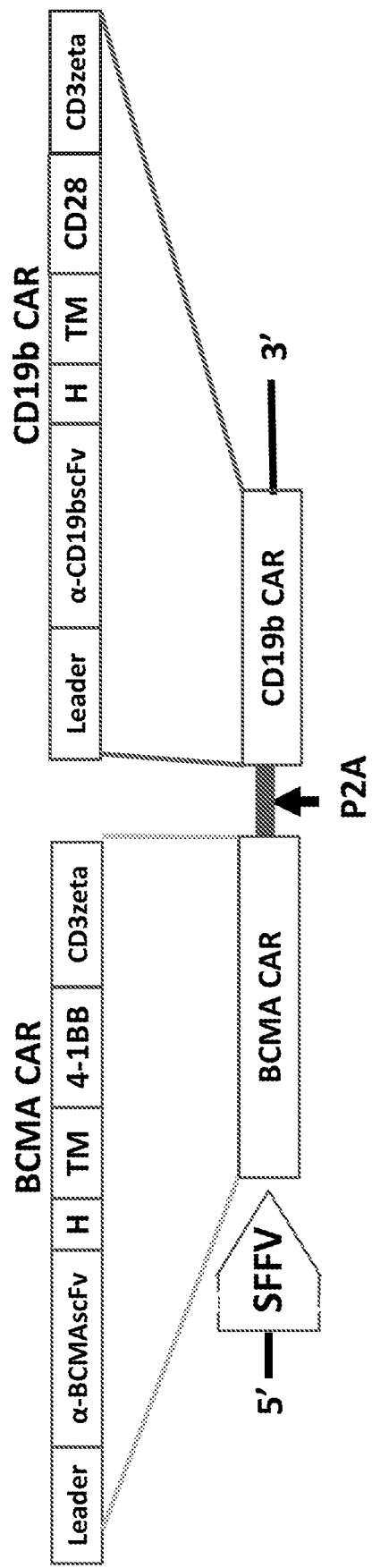

FIG. 85A. A schematic showing cCAR-T construct. The construct includes a SFFV strong promoter driving the expression of multiple modular units of CARs linked by a P2A self-cleaving peptide. Upon cleavage of the linker, the cCARs split and engage upon targets expressing BCMA (CD269) and/or CD19b. As a novel cCAR construct, the activation domains of the construct may include, but is not limited to, 4-1BB on the BCMA CAR unit and a CD28 region on the CD19b CAR unit.

Figure 85B:
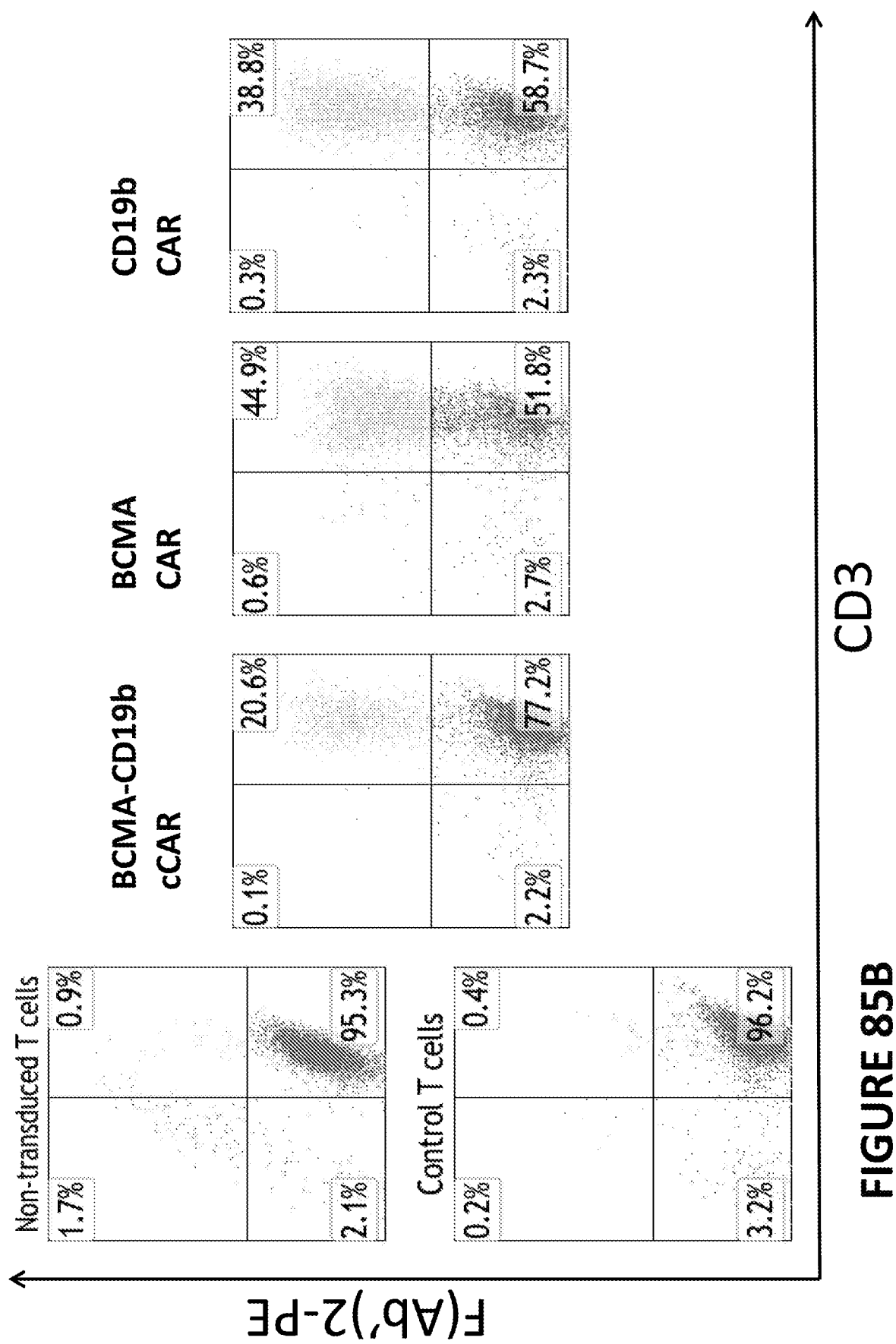

FIG. 85B. Transduction efficiency of T cells transduced with cCAR, CD19b-BB-2G, CD269-2G lentiviral vector. Expression of peripheral blood derived T-cells transduced with CAR lentiviruses. Peripheral blood T cells were transduced with either control vector, CD269CD19b-2G (cCAR), CD269-2G or CD19b-BB-2G CAR lentiviral vector. CD269CD19b-2G in a lentiviral vector contains two units of CARs, which are CD269-2G and CD19b-BB-2G targeting both CD269 and CD19 antigens. Forty-eight hours after recovery, cells were labeled with anti-mouse F(Ab')2-biotin antibody for detection of CAR phenotype. Panel 1 (left) contains cells that were not transduced. Panel 2 (second from left) shows the CD269-CD19b-2G cCAR T-cells while panels 3 (second from right) and 4 (far right) provide the expression data for CD269-2G CAR and CD19b-BB 2G CAR T-cells.

Figure 85C:
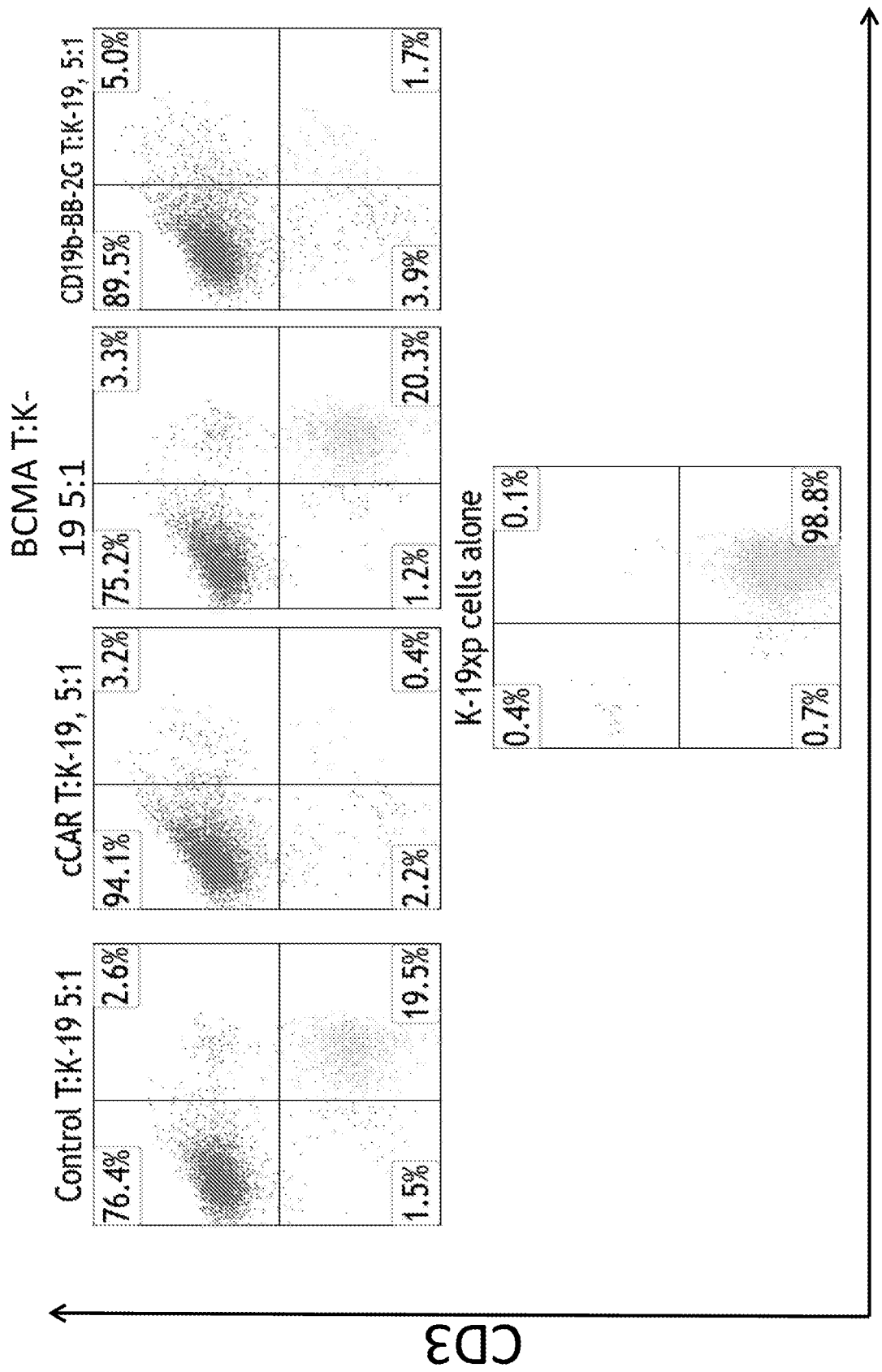

FIG. 85C. BCMA-CD19b cCAR T-cells lyse CD19-expressing K562 cells. Co-culture experiments were performed at an effector to target ratio of 5:1 for 16 hours and were directly analyzed by flow cytometry for mouse anti-human CD3pPerCp and mouse anti-human CD19-PE. Each assay includes target cells (K562 tumor cells artificially expressing CD19 antigen (K-19) co-cultured with either control T cells, (far left), cCAR (second from left), BCMA-2G CAR (second from right), or CD19b-BB-2G CAR (far right) T cells. Target cells alone (K-19×p) are shown at the bottom. N=2.

Figure 85D:
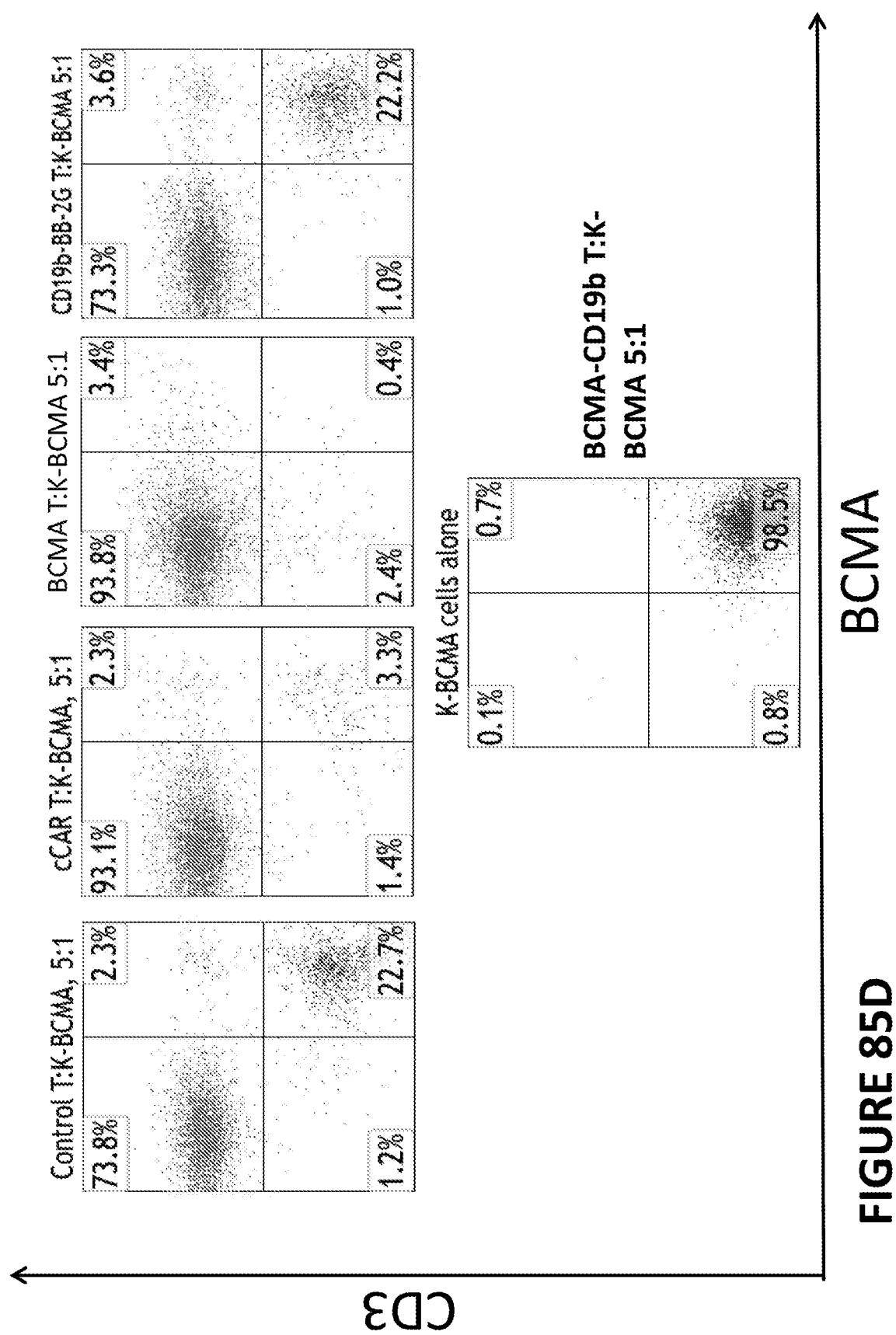

FIG. 85D—BCMA-CD19b cCAR T-cells lyse BCMA expressing K562 cells. Co-culture experiments were performed at an effector to target ratio of 5:1 for 16 hours and were directly analyzed by flow cytometry for mouse anti-human CD3pPerCp and mouse anti-human BCMA-APC. Each assay includes target cells (K562 tumor cells artificially expressing BCMA antigen (k-BCMA), and either Control (far left), cCAR (second from left), CD269-2G CAR (second from right), CD19b-BB-2G CAR (far from right) T cells. Target cells alone, BCMA-K (lower). N=2.

Figure 85E:
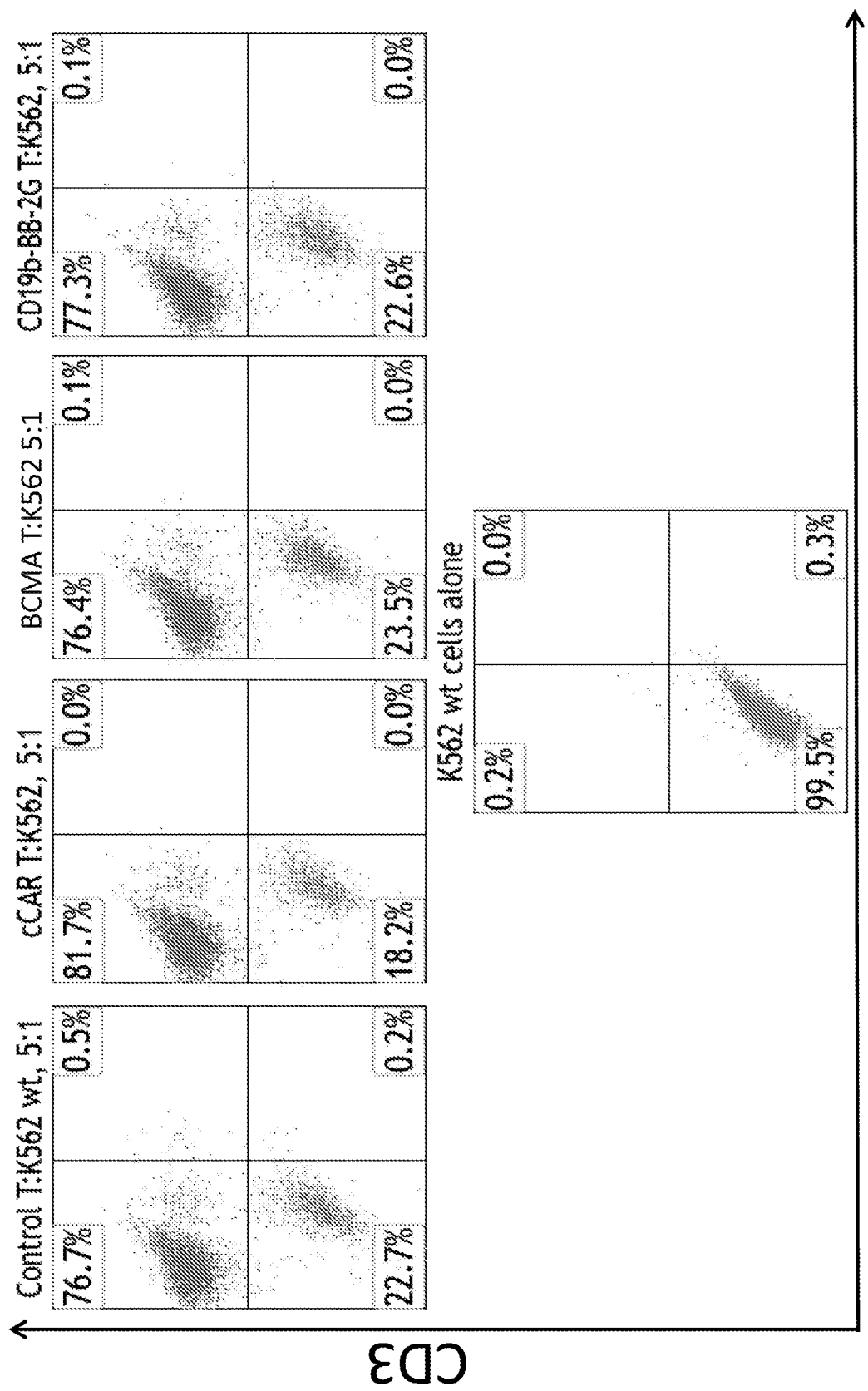

FIG. 85E. CARs specifically lyse only their own target epitopes. Figure showing that BCMA-CD19b cCAR T-cells do not lyse wild type K562 cells. Co-culture experiments were performed at an effector to target ratio of 5:1 for 16 hours and were directly analyzed by flow cytometry for mouse anti-human CD3pPerCp and mouse anti-human BCMA-APC. Each assay includes target cells (Either K562 wild type tumor cells not expressing CD19 antigen (A), CD269 antigen(B), or wt (C) vs control (far left), cCAR (second from left), CD269-2G (center), CD19b-BB-2G CAR (second from right) T cells. Target cells alone (K562 wild type, far right). N=2.

FIG. 86A. BCMA-CD19b cCAR lyses mixed artificial antigen expressing K562 cells for CD19 and BCMA, at ~E:T=5:2. Control and BCMA-CD19b cCAR cells were incubated with K562 cells expressing either CD19 (K-19) or BCMA (K-BCMA). K-19 and K-BCMA cells were mixed at a 1:1 ratio ($10^5:10^5$ cells) and then control or T-cells were added to a final E:T ratio of 5:2. Cultures were incubated for 24 and 48 hours and flow cytometry performed to quantify residual target antigen population in culture using CD3, BCMA, and CD19 antibodies. Purple populations represent BCMA-CD19+CD3− K-19 cells and teal populations represents BCMA+CD19-CD3− K-BCMA cells. N=2.

Figure 86B:
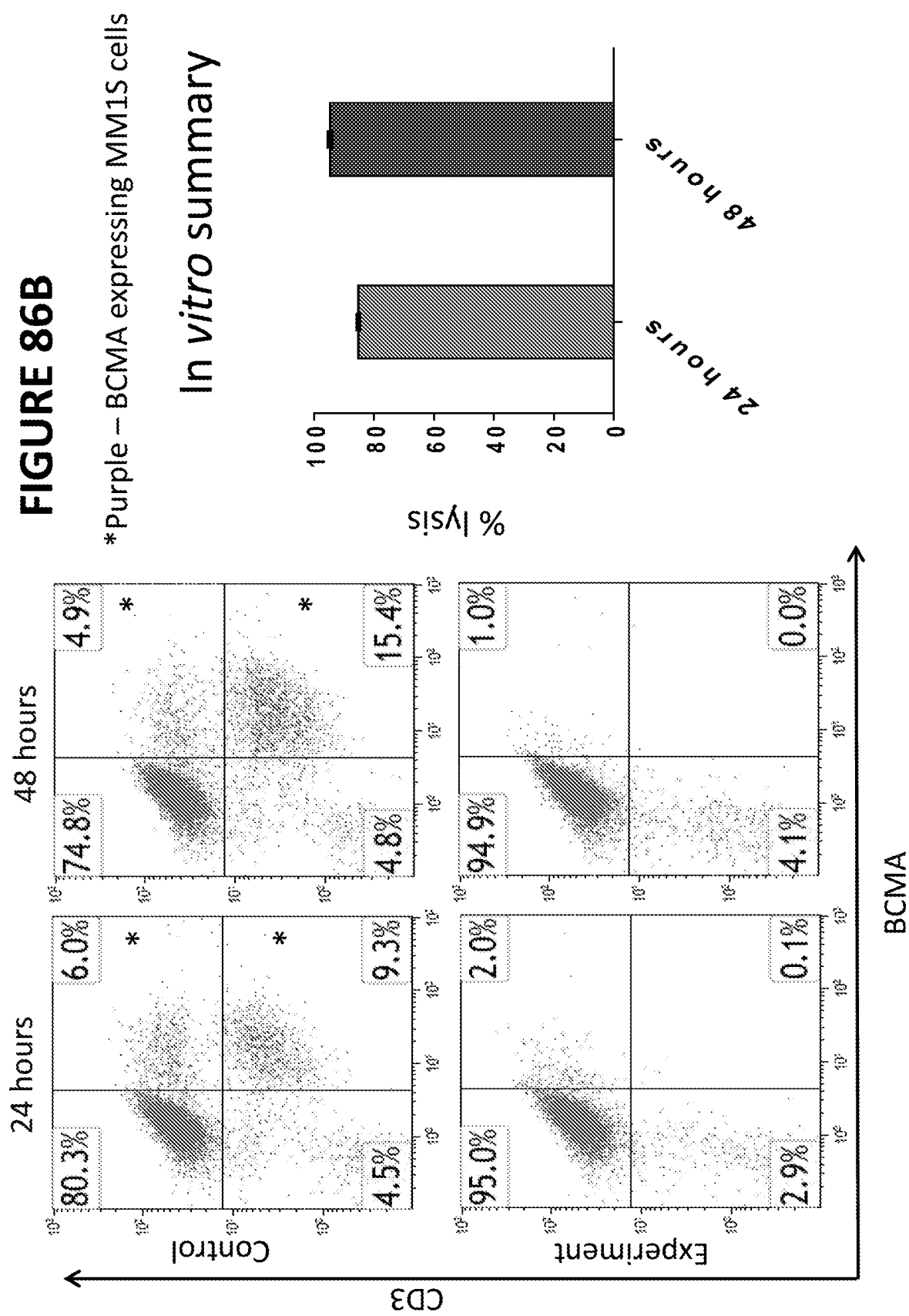

FIG. 86B. BCMA-CD19b cCAR T-cells are able to lyse BCMA+ multiple myeloma cell line MM1S. Control and BCMA-CD19b CAR cells were incubated with a myeloma cell line—MM1S, that is strictly positive for BCMA at an E:T ratio of 5 to 1. Co-cultures were setup with 24 and 48 hour incubation times and flow cytometry acquisition with CD3 and BCMA antibodies for analysis. Purple populations represent BCMA+MM1S cells. N=2 FIG. 86C. BCMA-CD19b cCAR lyses MM1S at high efficiency. Control, CD19b and BCMA-CD19b CAR cells were incubated with a myeloma cell line—MM1S (prestained with Celltracker (CMTMR), that is strictly positive for BCMA at an E:T ratio of 2:1 and 5:1. Co-cultures were setup with 48 hour incubation times and flow cytometry acquisition with CD3 and BCMA antibodies for analysis. Blue populations represent BCMA+MM1S cells.

Figure 86D:
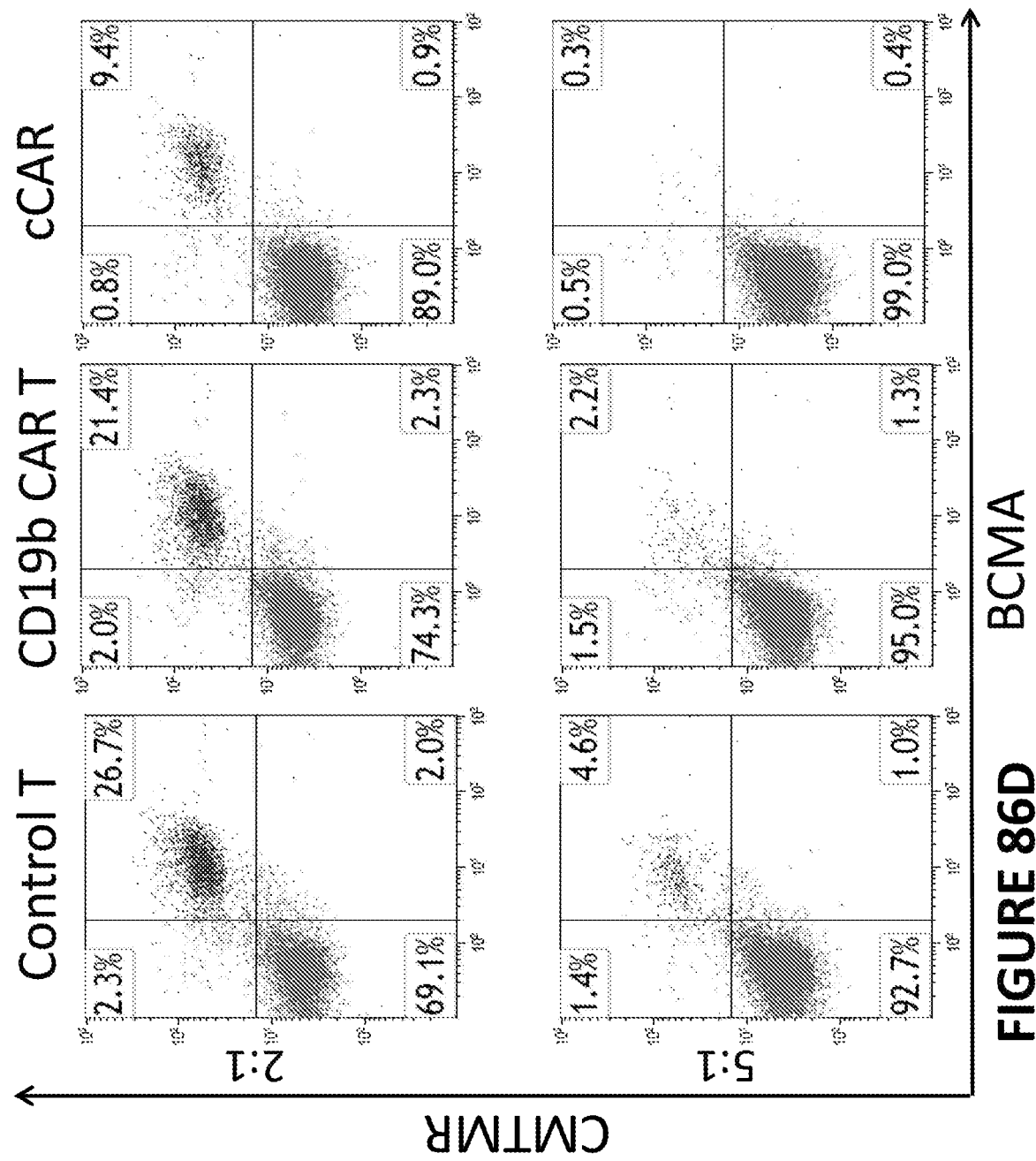

FIG. 86D. BCMA-CD19b cCAR lyses RPMI-8226 multiple myeloma cell at high efficiency. Control, CD19b and BCMA-CD19b CAR cells were incubated with a myeloma cell line—RPMI-8226 (prestained with Celltracker CMTMR), that is strictly positive for BCMA at an E:T ratio of 2:1 and 5:1. Co-cultures were setup with 48 hour incubation times and flow cytometry acquisition with CD3 and BCMA antibodies for analysis. Blue populations represent BCMA+ RPMI-8226 cells.

Figure 86E:
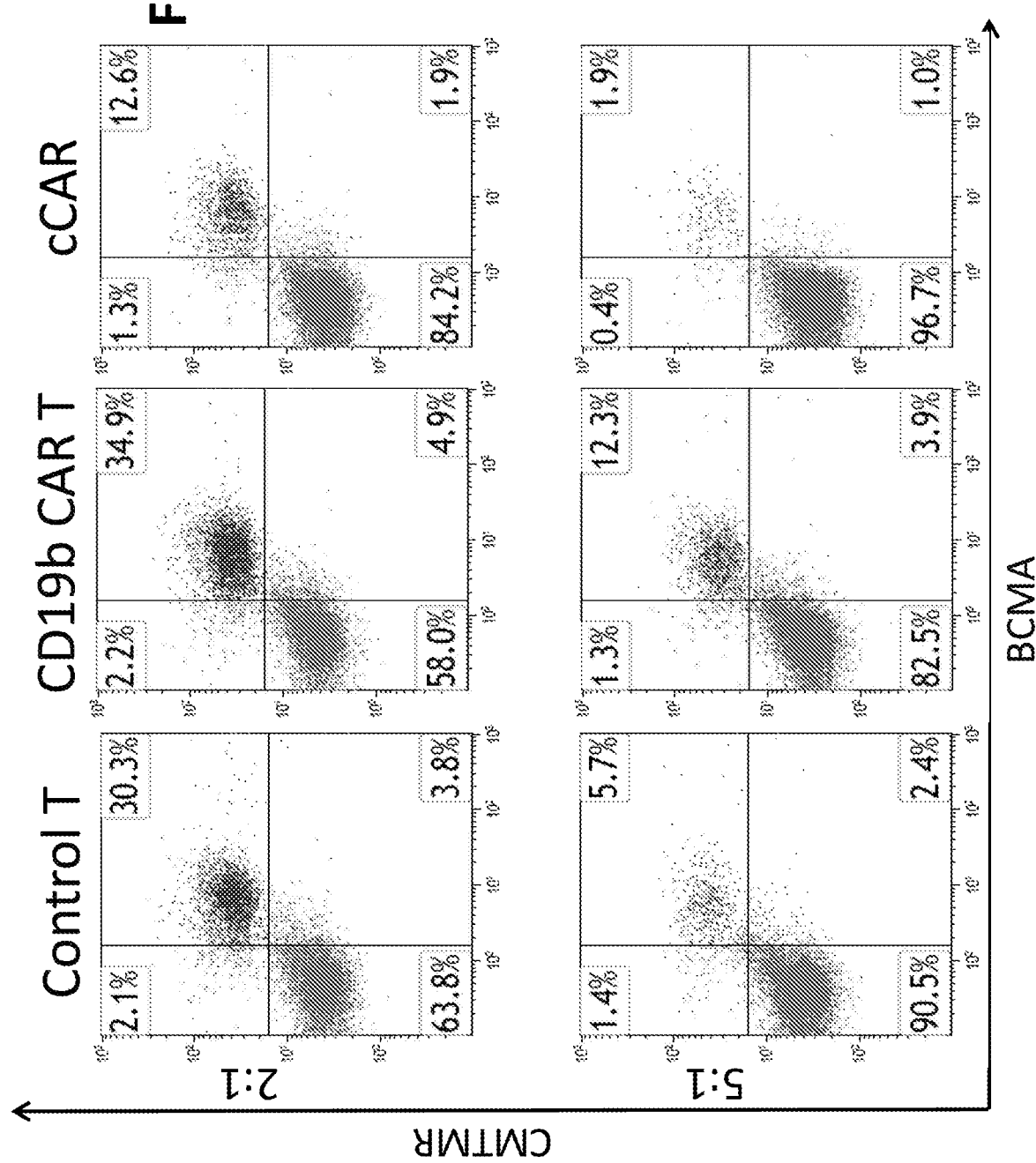

FIG. 86E. BCMA-CD19b cCAR lyses U266 at high efficiency. Control, CD19b and BCMA-CD19b CAR cells were incubated with a myeloma cell line—U266 (prestained with Celltracker CMTMR), that is strictly positive for BCMA at an E:T ratio of 2:1 and 5:1. Co-cultures were setup with 48 hour incubation times and flow cytometry acquisition with CD3 and BCMA antibodies for analysis. Blue populations represent BCMA+U266 cells.

Figure 87A:
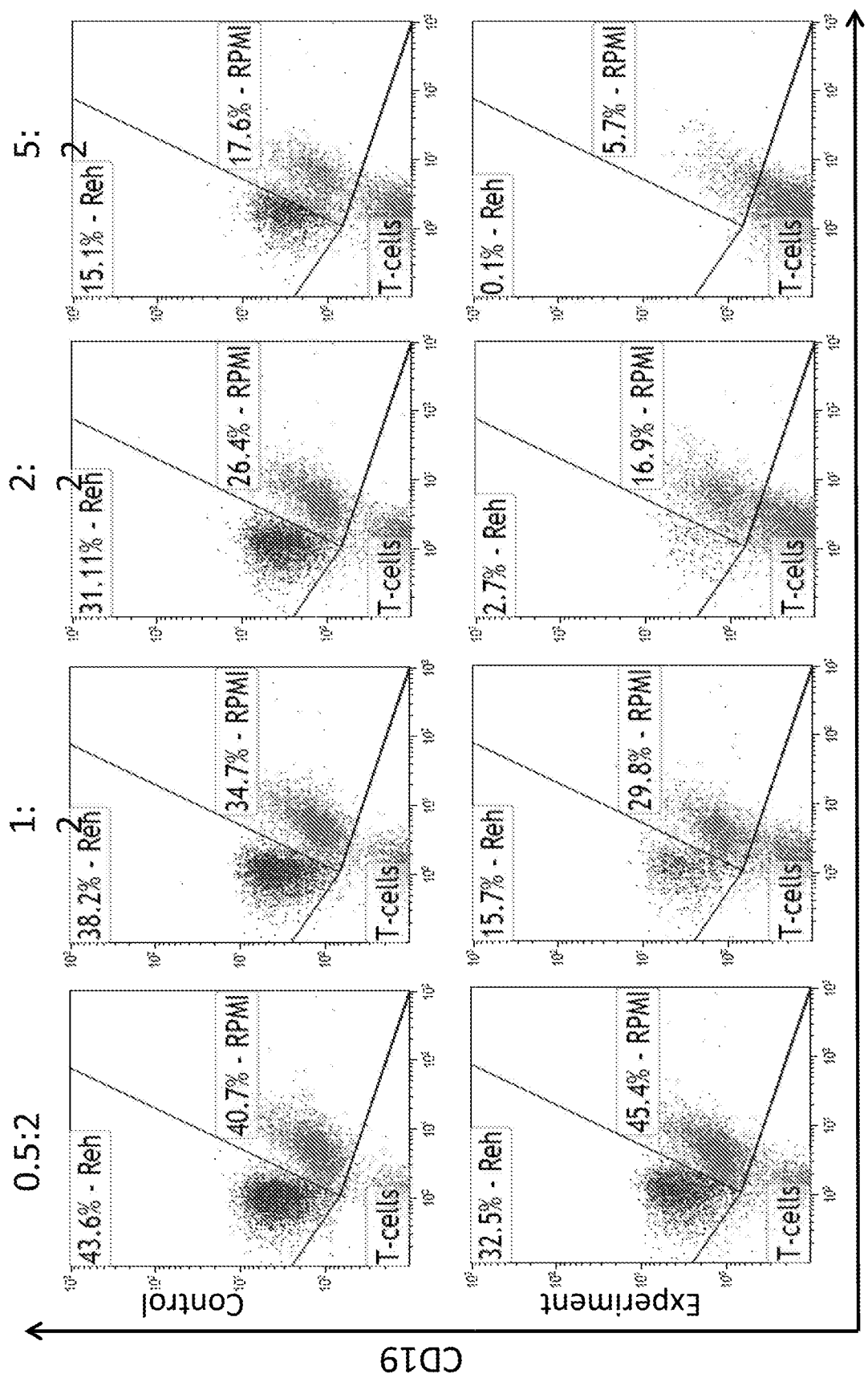

FIG. 87A. BCMA-CD19b cCAR T-cells can lyse mixed tumor populations, myeloma cells and B-ALL cells. Control and BCMA-CD19b CAR cells were incubated with a mixture of CD19+ REHREH cells and BCMA+ RPMI-8226 cells. Co-cultures were setup with 24 hour incubation times at escalating E:T ratios and flow cytometry acquisition with CD3, CD19, and BCMA antibodies for analysis. Purple populations represent BCMA+ RPMI-8226 cells, blue populations REHREH cells. N=2. BCMA-CD19b cCAR T-cells can be used to ablate plasma cell and B-cell populations associated with autoimmune disorders.

Figure 87B:
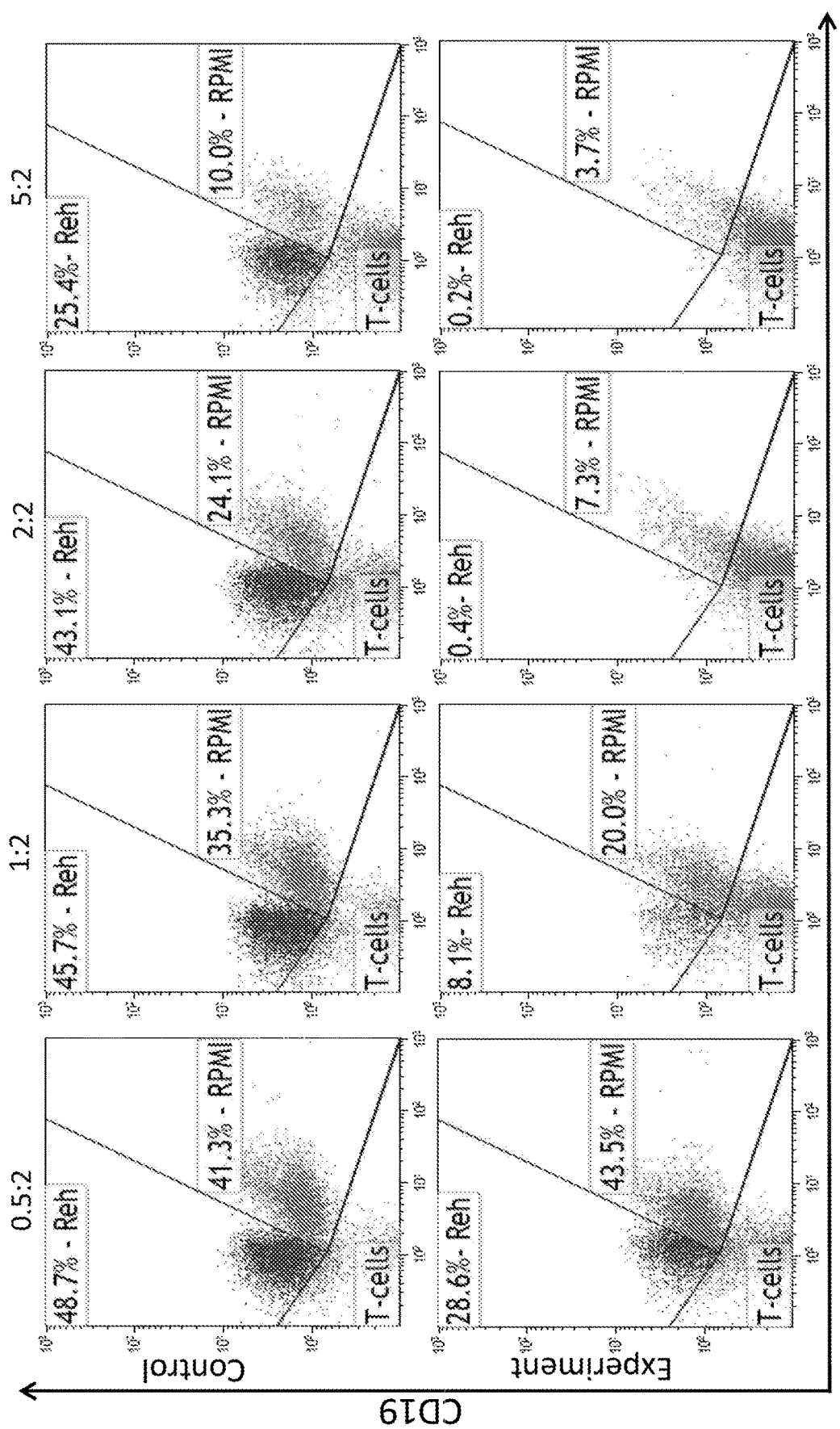

FIG. 87B. BCMA-CD19b cCAR T-cells are able to lyse mixed tumor populations, myeloma cells and B-ALL cells. Control and BCMA-CD19b CAR cells were incubated with a mixture of CD19+ REH cells and minority BCMA+ RPMI-8226 cells. Co-cultures were setup with 48 hour incubation times at escalating E:T ratios and flow cytometry acquisition with CD3, CD19, and BCMA antibodies for analysis. Purple populations represent BCMA+ RPMI-8226 cells, blue populations REH cells. N=2. REH (REH) is a CD19+B-ALL cell line and RPMI-8226 is a myeloma cell line expressing BCMA.

Figure 88A:
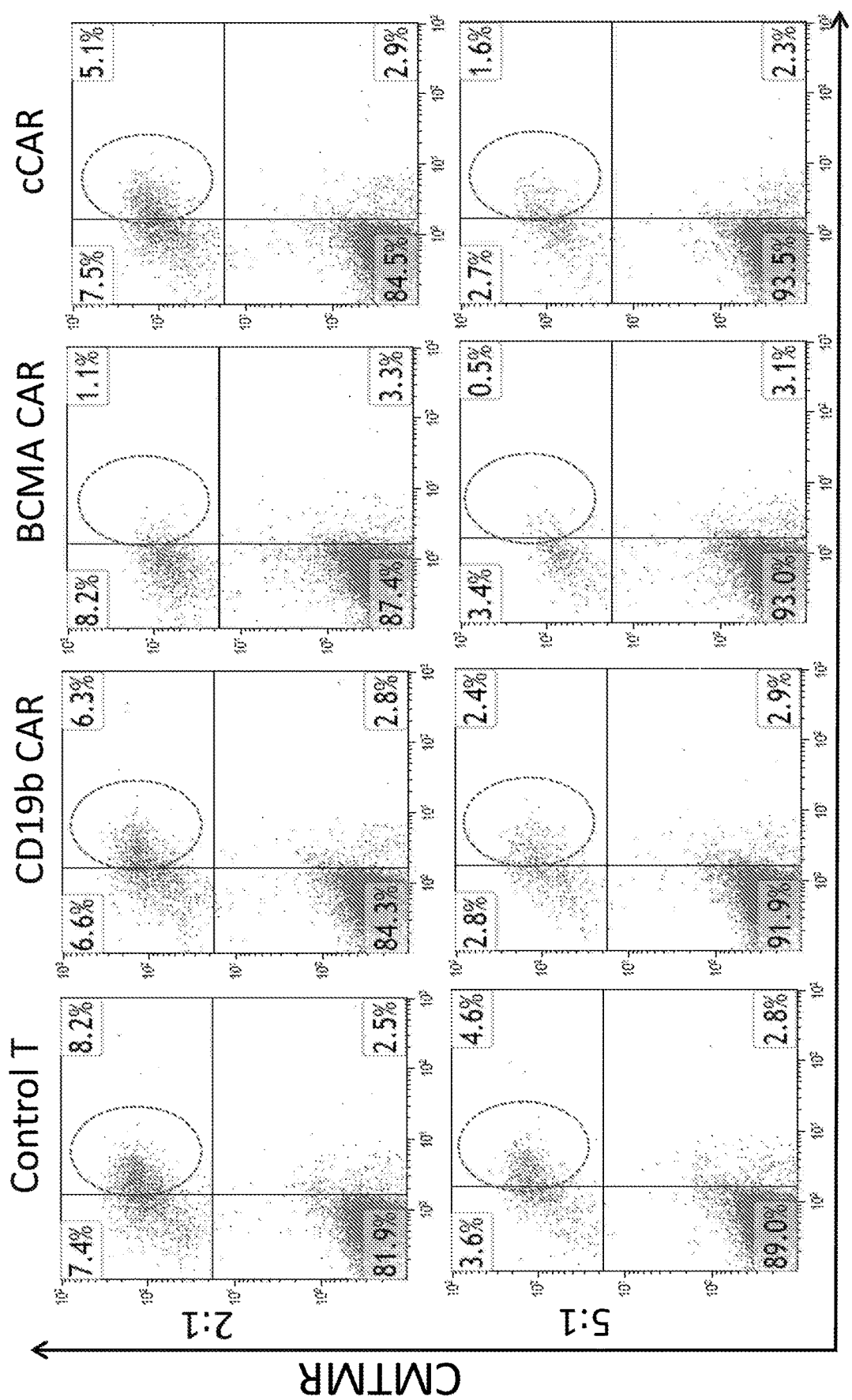

FIG. 88A. CD269-CD19b cCAR T-cells are able to target primary myeloma cells MM7-G. BCMA-CD19b cCAR lyses primary myeloma cells MM7-G. Control and BCMA-CD19b CAR cells were incubated with a subset BCMA+ MM7-G primary myeloma cells. MM7-G cells were prestained with CMTMR Celltracker dye. Co-cultures were setup with 24 hour incubation times at 2:1 and 5:1 E:T ratios and flow cytometry acquisition with CD3 and BCMA antibodies for analysis. Encircled populations represent BCMA+MM7-G cells. Comparisons with CD19b and BCMA single CARs are provided.

Figure 88B:
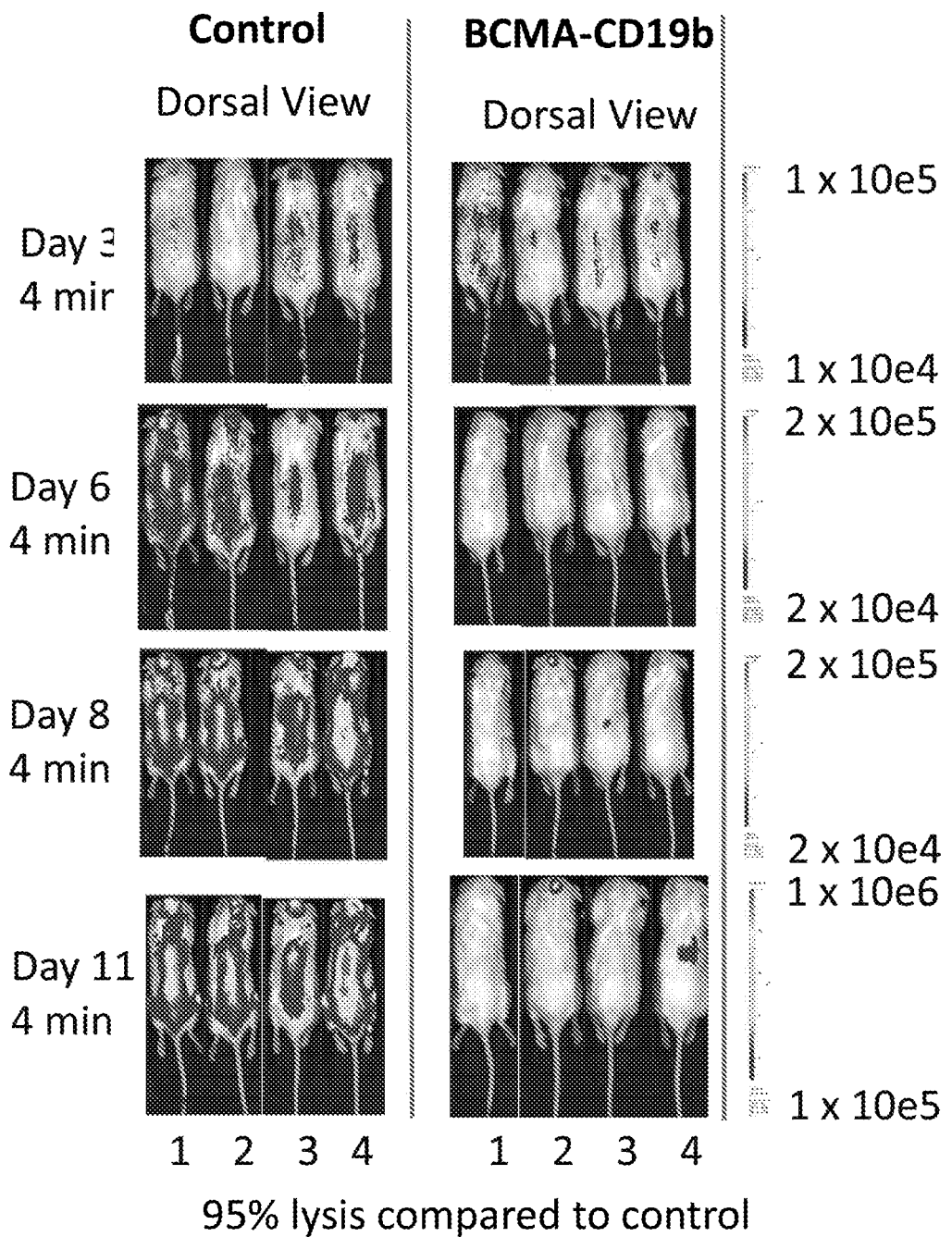

FIG. 88B. BCMA-CD19b cCAR mice are able to control growth of mixed tumor populations. BCMA-CD19b cCAR lyses mixed antigen tumor cell populations in vivo. NSG mice were sublethally irradiated and, after 24 hours, intravenously injected with a 1:1 mix comprising of $1 \times 10^6$ luciferase-expressing CD19+ REH and BCMA+MM1S cells (Day 1) to induce measurable tumor formation. Three days following tumor injection, mice were injected with $10 \times 10^6$ cells of either control, BCMA-CD19b cCAR T-cells. On days 6, 8, and 11, mice were injected subcutaneously with RediJect D-Luciferin and subjected to IVIS imaging. Tumor intensity is quantified as luciferin signal (photons/sec).

Figure 88C:
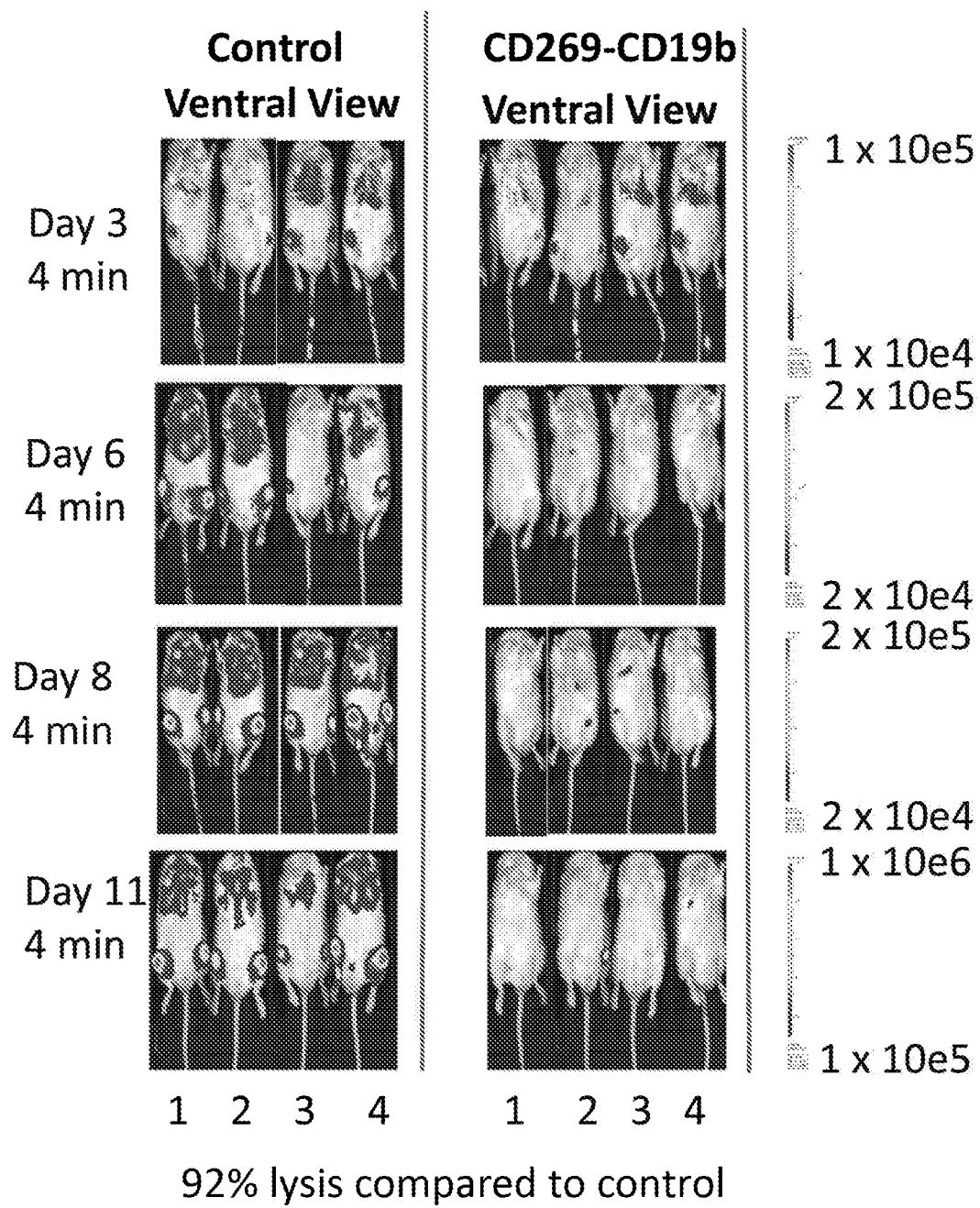

FIG. 88C. BCMA-CD19b cCAR mice are able to control growth of mixed tumor populations (VENTRAL side). BCMA-CD19b cCAR lyses mixed antigen tumor cell populations in vivo. NSG mice were sublethally irradiated and, after 24 hours, intravenously injected with a 1:1 mix comprising of $1 \times 10^6$ luciferase-expressing CD19+ REH and BCMA+MM1S cells (Day 1) to induce measurable tumor formation. Three days following tumor injection, mice were injected with $10 \times 10^6$ cells of either control, CD269-CD19b cCAR, T-cells. On days 6, 8, and 11, mice were injected subcutaneously with RediJect D-Luciferin and subjected to IVIS imaging. Tumor intensity is quantified as luciferin signal (photons/sec).

Figure 89A:
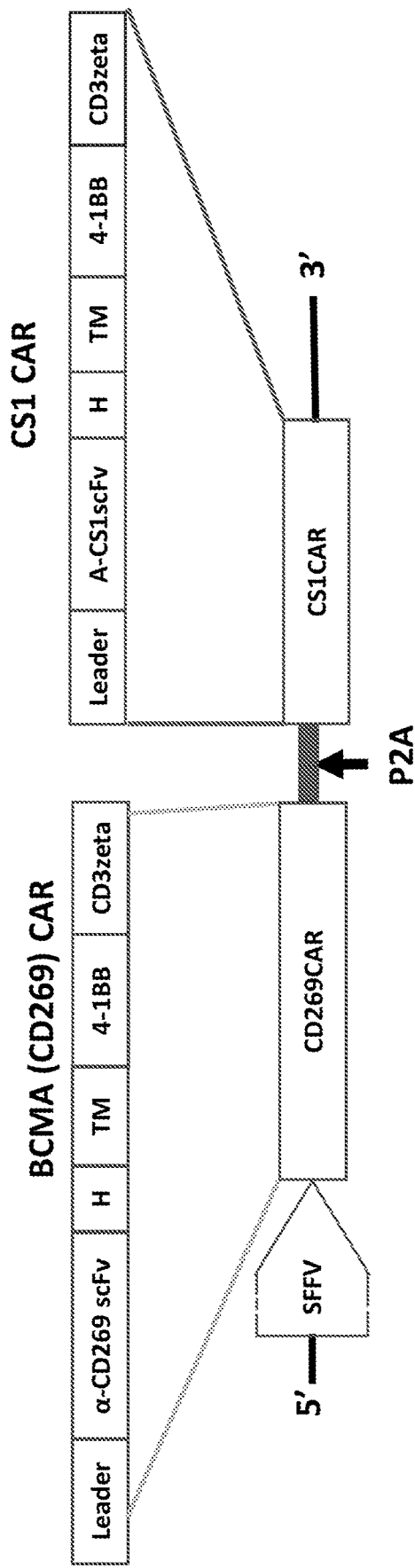

FIG. 89A. A schematic representation of cCAR-T construct containing two units of CARs, BCMA and CS1 (BC1cCAR). The construct includes a SFFV promoter driving the expression of multiple modular units of CARs linked by a P2A peptide. Upon cleavage of the linker, the cCARs split and engage upon targets expressing BCMA (CD269) and/or CS1 (CD319 or Slamf7) As a novel cCAR construct, the activation domains of the construct may include, but is not limited to, 4-1BB on both the BCMACAR segment and the CS1 CAR. BCMA CAR unit in the cCAR can be selected from one of the group, BCMA-A7D-28-2G CAR, and BCMA-C11D-28-2G CAR. CS1 CAR unit in the cCAR can be selected from one of the group, CS1-mu34-28-2G CAR, CS1-mu90-28-2G CAR and CS1-hu63-28-2G CARs.

Figure 89B:
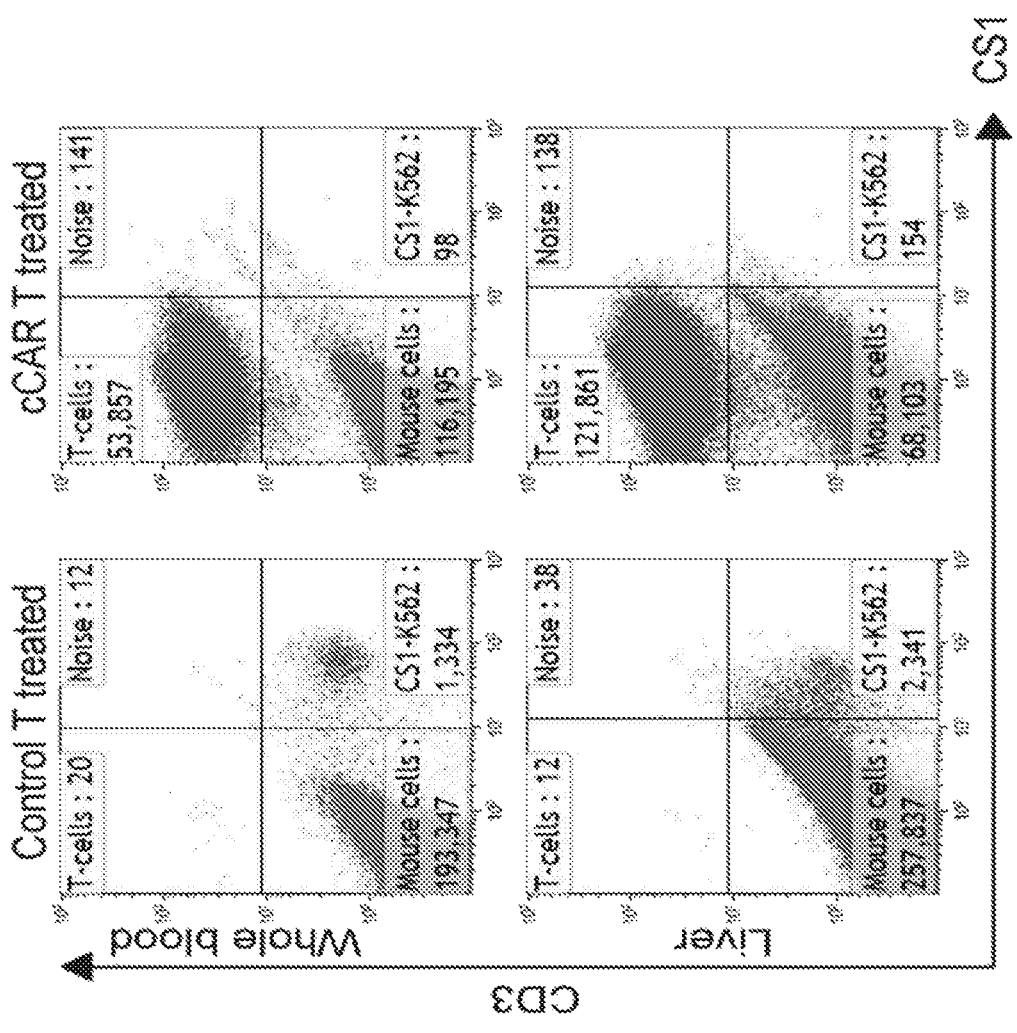
Figure 89C:
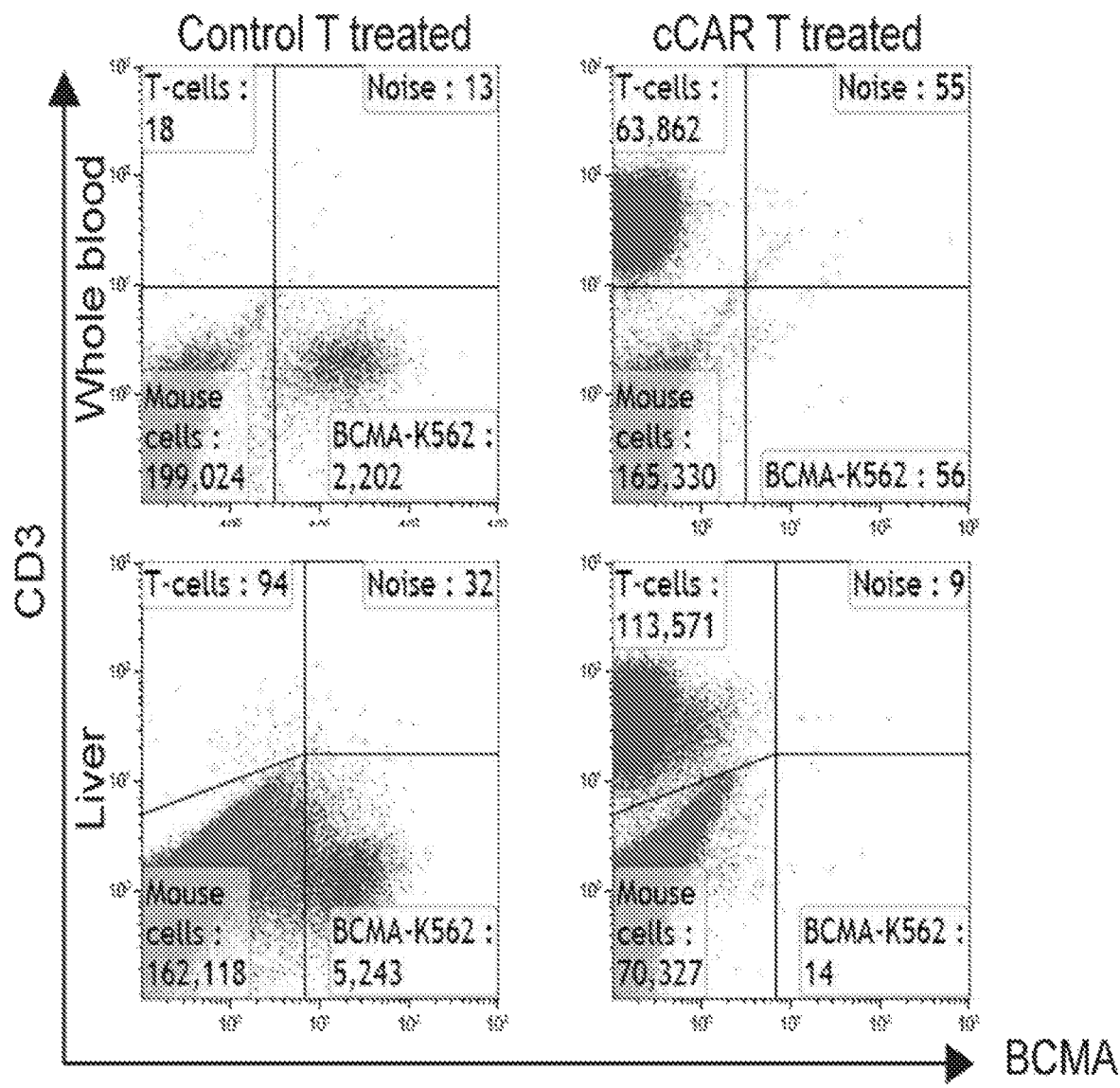

FIGS. 89B and 89C. Analysis of BCMA-CS1 cCAR T cell persistency and tumor depletion. A compound CAR (BCMA-CS1 cCAR was generated and its functions were characterized above (FIGS. 24 to 29). To construct a model for potential antigen escape or multiple antigen tumor populations, we designed a xenogeneic mouse model using NSG mice sublethally irradiated and intravenously injected with luciferase-expressing K562 cells expressing either stably transduced BCMA or CS1. BCMA and CS1 expressing K562 cells (BCMA-K562 and CS1-K562) were further sorted for expression following puromycin selection and established as stable homogenous single antigen populations. BCMA and CS1 expressing K562 cells were then mixed at a 4:1 ratio respectively before injection to model potential antigen escape. Whole blood and liver tissue samples were taken from representative mice in the CS1-K562 experimental group at time of sacrifice and were labeled with CD3, CD45, and CS1 antibodies to screen for tumor and CAR T-cell persistency. Two such representative flow diagrams are shown. All control and cCAR mice showed the same trends across each mouse for their respective treatment groups (n=19). Control mice showed low T-cell persistency (blue) with a very small or no T cell population, and apparent CS1-K562 tumor populations (purple) when compared to cCAR treated (FIG. 89B) with a large population of T cells, and no tumor population detected. Similar experimental setup and collection were conducted for the BCMA-K562 experimental group and similar trends in tumor ablation and T-cell persistency in the cCAR treated mice are observed (FIG. 89C).

Figure 90:
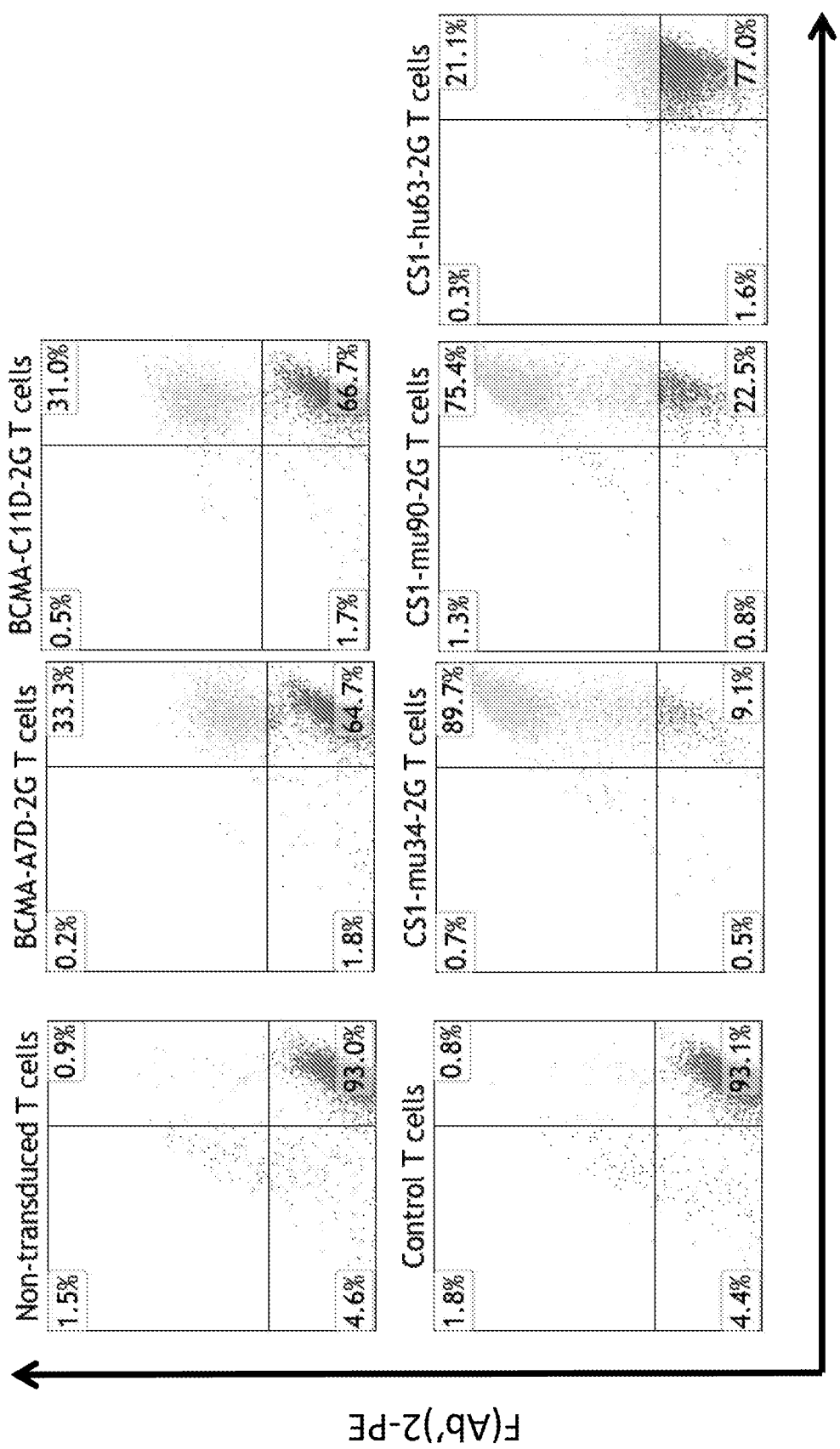

FIG. 90. Expression of peripheral blood derived T-cells transduced with CAR lentiviruses. Peripheral blood T cells were transduced with either control vector (bottom right), BCMA-A7D-28-2G, BCMA-C11D-28-2G, CS1-mu34-28-2G, CS1-mu90-28-2G or CS1-hu63-28-2G CAR lentiviral vector. Forty-eight hours after recovery, cells were labeled with anti-mouse F(Ab')2-biotin antibody for detection of CAR phenotype. Upper far left contains cells that were not transduced. Upper center and far right panels show the BCMA-A7D-2G and BCMA-C11D-2G CAR T cells respectively, while lower second right, and far right provide the expression data for CS1-mu34, CS1-mu90 and CS1-hu63 CAR T-cells, respectively.

Figure 91A:
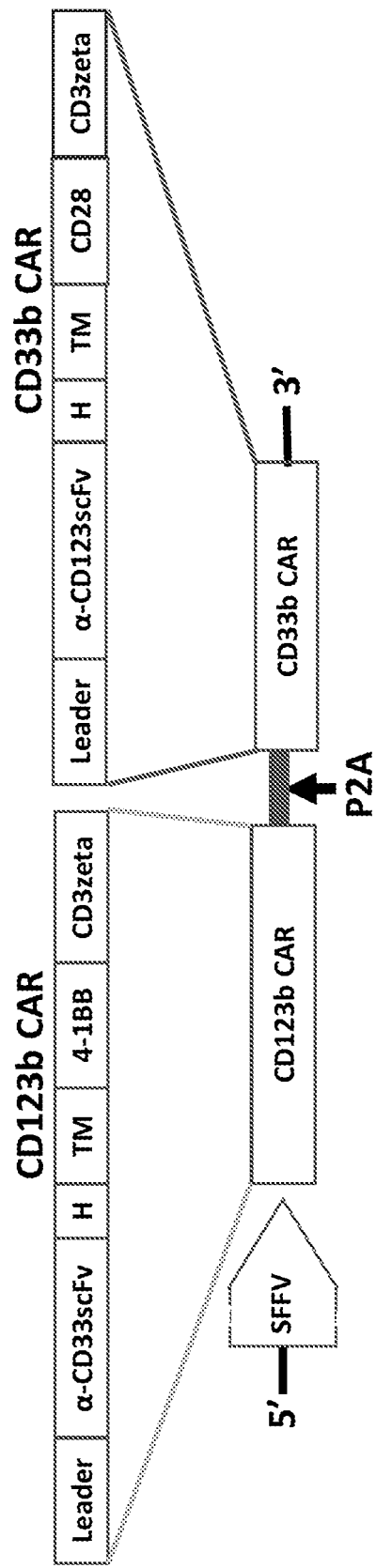

FIG. 91A. A schematic representation of cCAR-T construct, CD123b-CD33b cCAR targeting either CD123 or CD33 or both antigen. The construct includes a SFFV promoter driving the expression of multiple modular units of CARs linked by a P2A peptide. Upon cleavage of the linker, the cCARs split and engage upon targets expressing C123 and/or CD33. As a novel cCAR construct, the activation domains of the construct may include, but is not limited to, 4-1BB on the CD123 CAR unit and a CD28 on the 33b CAR unit.

Figure 91B:
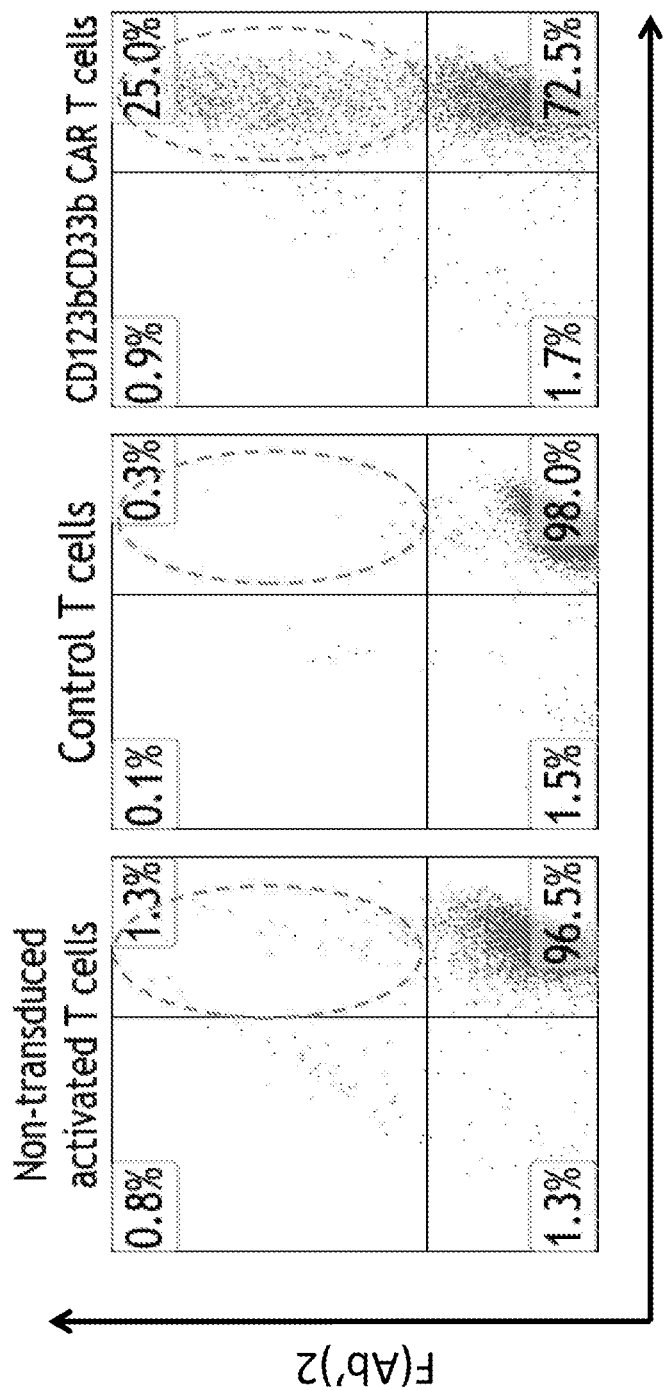

FIG. 91B. Expression of CD123bCD33b CAR T cells. PMBC buffy coat T cells were activated 3 days with anti-CD3 antibody. Cells were transduced with either control vector (middle) or CD123b CD33b CAR (right) lentiviral supernatant. After 3 days of incubation, cells were harvested and labeled for flow cytometry. PMBCs prior to activation (left) were also labeled the same way with the same antibodies and in the same manner as the transduced cells.

FIG. 91C. CD123bCD33b CAR T cells can ablate CD33-expressing MOLM13 tumor cell line in co-culture assays. Co-culture experiments were performed at an effector to target ratio of 2:1 or 5:1 for 16 hours and were directly analyzed by flow cytometry for CD33 and CD3. Each assay includes MOLM13 target cells vs control (left), CD123bCD33b CAR T cells (center) and target cells alone (right). The plot in in the bottom right shows CD33 and CD123 phenotype of MOLM13 cells.

Figure 91D:
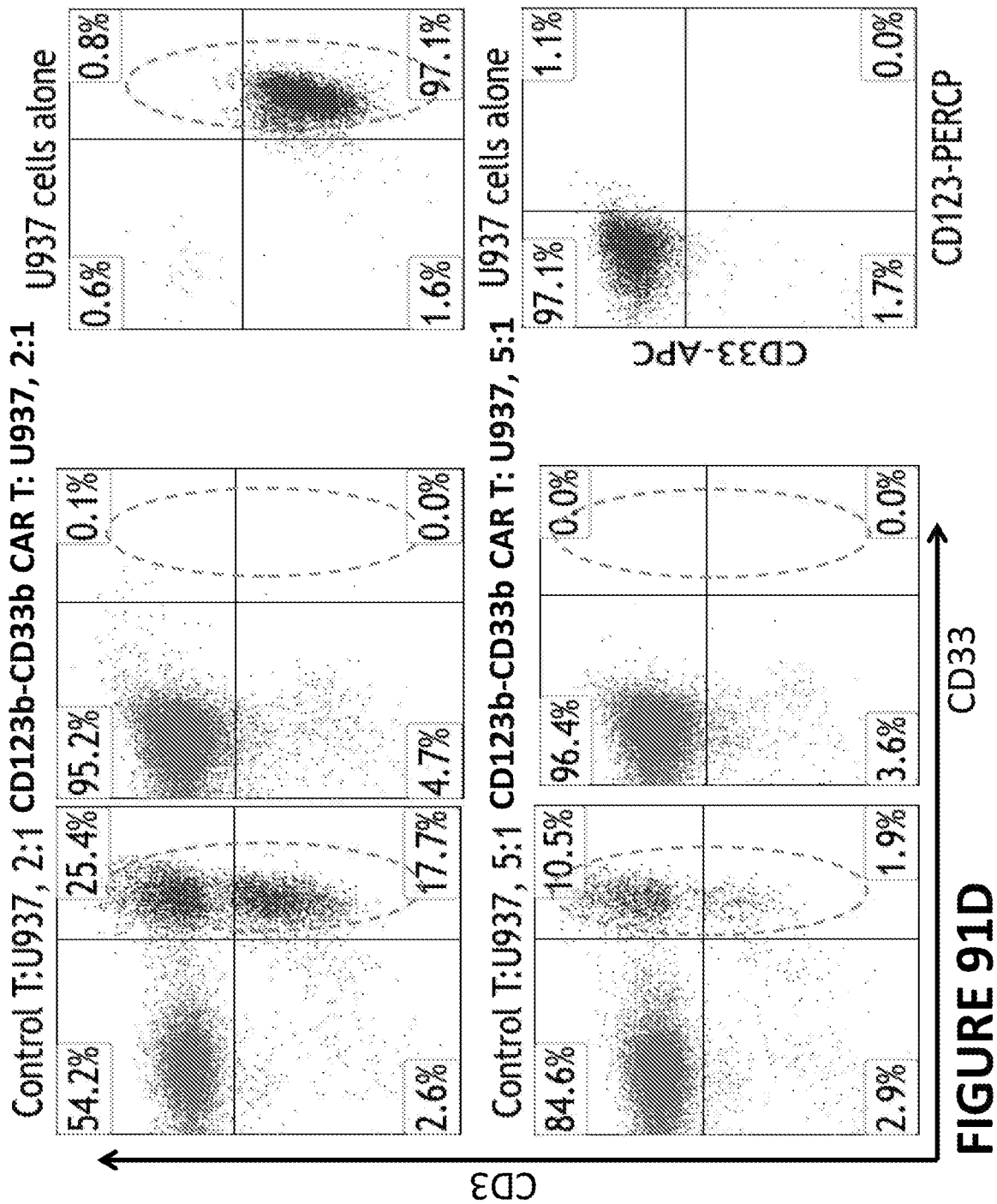

FIG. 91D. CD123bCD33b CAR T cells are able to ablate CD33-expressing U937 tumor cell line in co-culture assays. CD123bCD33b-2G CAR T cells deplete CD33+/CD123-U937 cells. Co-culture experiments were performed at an effector to target ratio of 2:1 or 5:1 for 16 hours and were directly analyzed by flow cytometry for CD33 and CD3. Each assay includes U937 target cells vs control (left), CD123bCD33b CAR T cells (center) and target cells alone (right). The plot in in the bottom right shows CD33 and CD123 phenotype of U937 cells.

Figure 91E:
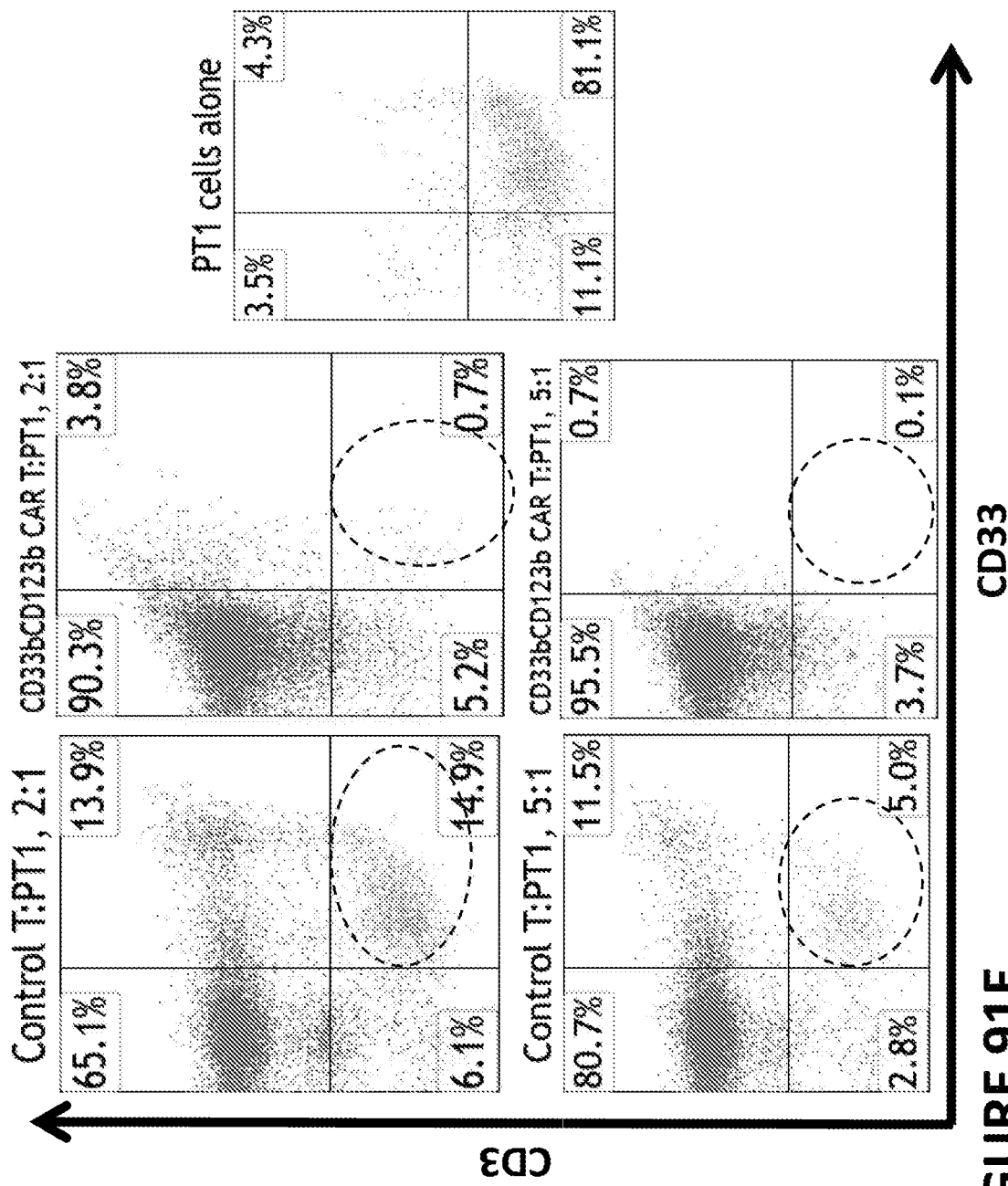

FIG. 91E. CD123bCD33b CAR T cells are able to ablate AML patient cells (PT-1) expressing CD33 and Cd123 in co-culture assays. Co-culture experiments were performed at an effector to target ratio of 2:1 and 5:1 for 24 hours and were directly analyzed by flow cytometry for CD3 and CD33. Assay includes AML patient cells vs control (left), CD123 CD33 CAR T cells (center) and target cells alone (far right).

Figure 91F:
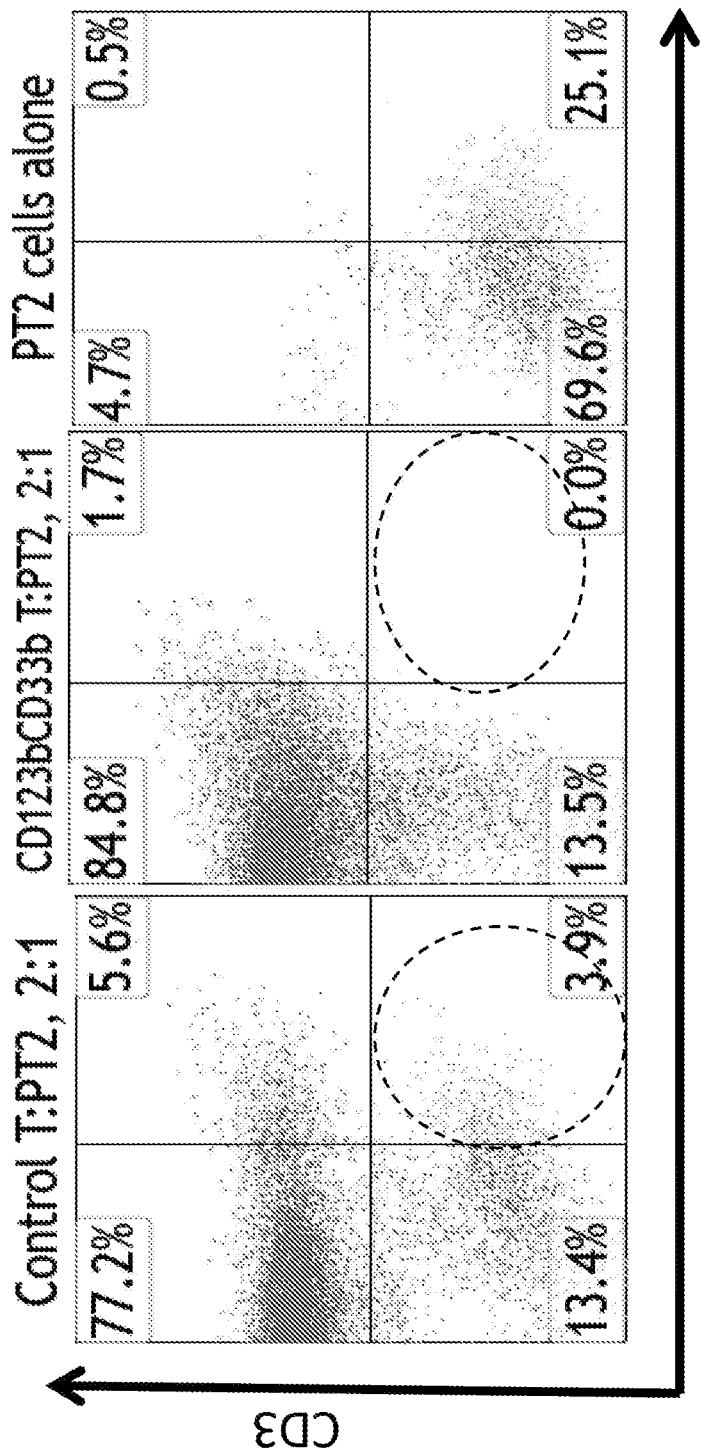

FIG. 91F. CD123bCD33b CAR T cells are able to ablate B-ALL patient cells (PT-2) expressing CD123 and CD19 in co-culture assays. B-ALL14-BM (PT2). Co-culture experiments were performed at an effector to target ratio of 2:1 for 24 hours and were directly analyzed by flow cytometry for CD3 and CD123. Assay includes B-ALL patient cells vs control (left), CD123 CD33 CAR T cells (center) and target cells alone (far right).

Figure 91G:
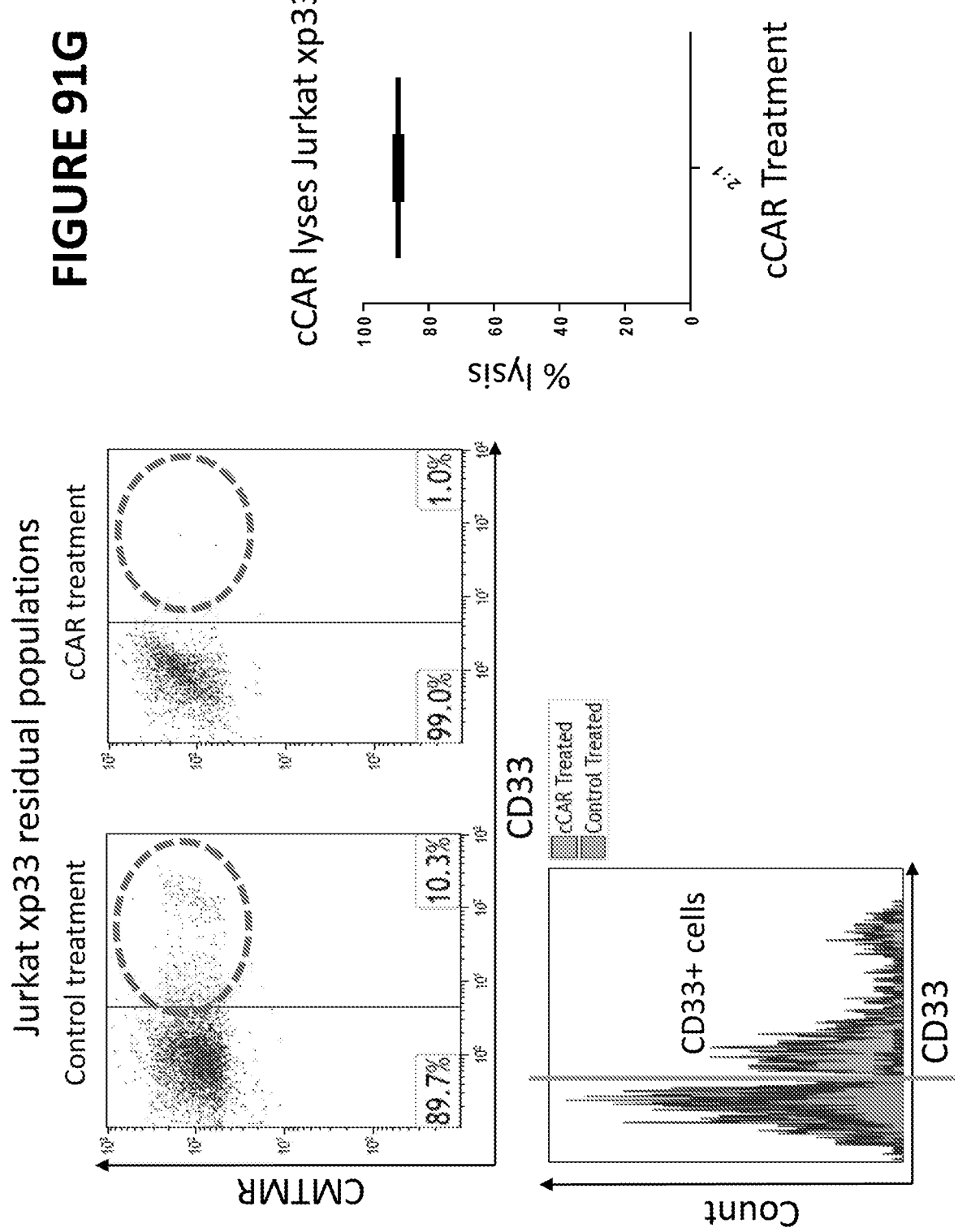

FIG. 91G. CD123-CD33-28-2G cCAR (cCAR) T-cells are able to selectively and potently lyse CD33 expressing target cells. CD123b-CD33b-28-2G depletion of CD33 specific populations. (A) cCAR T-cells were incubated with a T-ALL cell line Jurkat that was transduced to express CD33. Jurkat expressing CD33 cells (Jurkat xp33) only constitute a small fraction of the total Jurkat population, however, compared to control, cCAR T-cells were able to fully ablate target cells expressing CD33 but not CD33 negative Jurkate cells after 24 hours of culture, even at an E:T ratio of 2:1. Flow plots showing depletion of CD33+ Jurkat cells (purple). Jurkat cells were prelabeled with cytotracker (CMTMR-PE). (B) Histogram visualization of the disappearance of CD33+ cell populations after cCAR treatment (pink) versus control (gray). (C) Graphical summary of cCAR lysis of CD33+ Jurkat cells after co-culture.

FIG. 91H. CD123b-CD33b-2G cCAR T-cells deplete CD34+ AML leukemia blasts. Leukemic blasts were gated for CD34 expression and population was then expressed as a fraction of % gated. AML-18-G cells (human AML sample) were almost exclusively CD34+ leukemic blasts. Primary AML CD34+ bulk disease depletion was analyzed via FACS. N=2 Co-cultures were conducted with varying E:T ratios (2:1, 5:1 and 10:1).

Figure 91I:
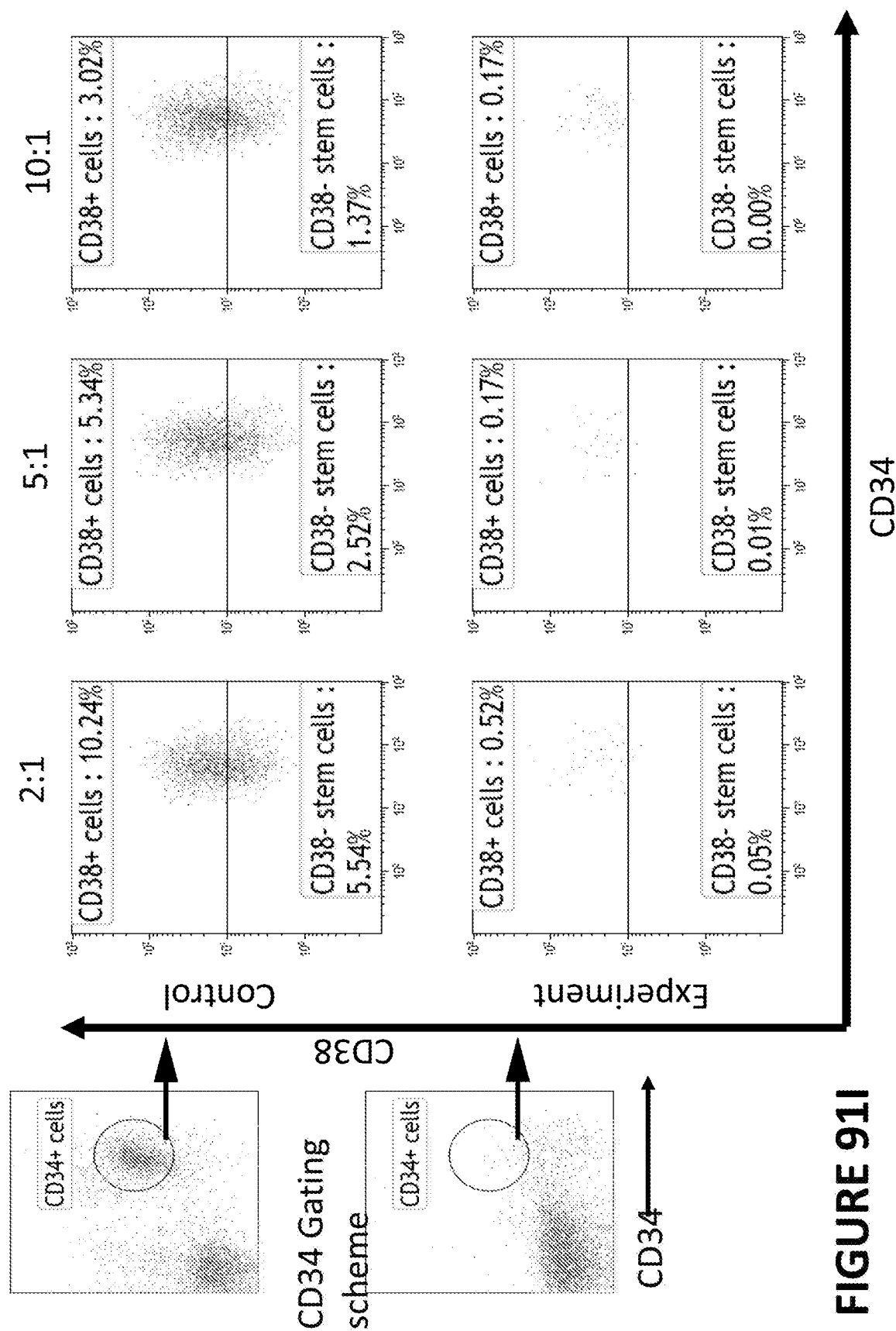

FIG. 91I. CD123b-CD33b-2G cCAR T-cells deplete human leukemic stem cells (AML-18-G primary cells). Leukemic stem cells were gated first for CD34 expression and population was then isolated and analyzed for CD34 and CD38 expression. Gating reveals that both types of CD34 positive populations, CD34+CD38– and CD34+CD38+ are essentially depleted by the cCAR as analyzed by % total of residual cells. CD34+/CD38– leukemic stem cells were notably depleted.

Figure 91J:
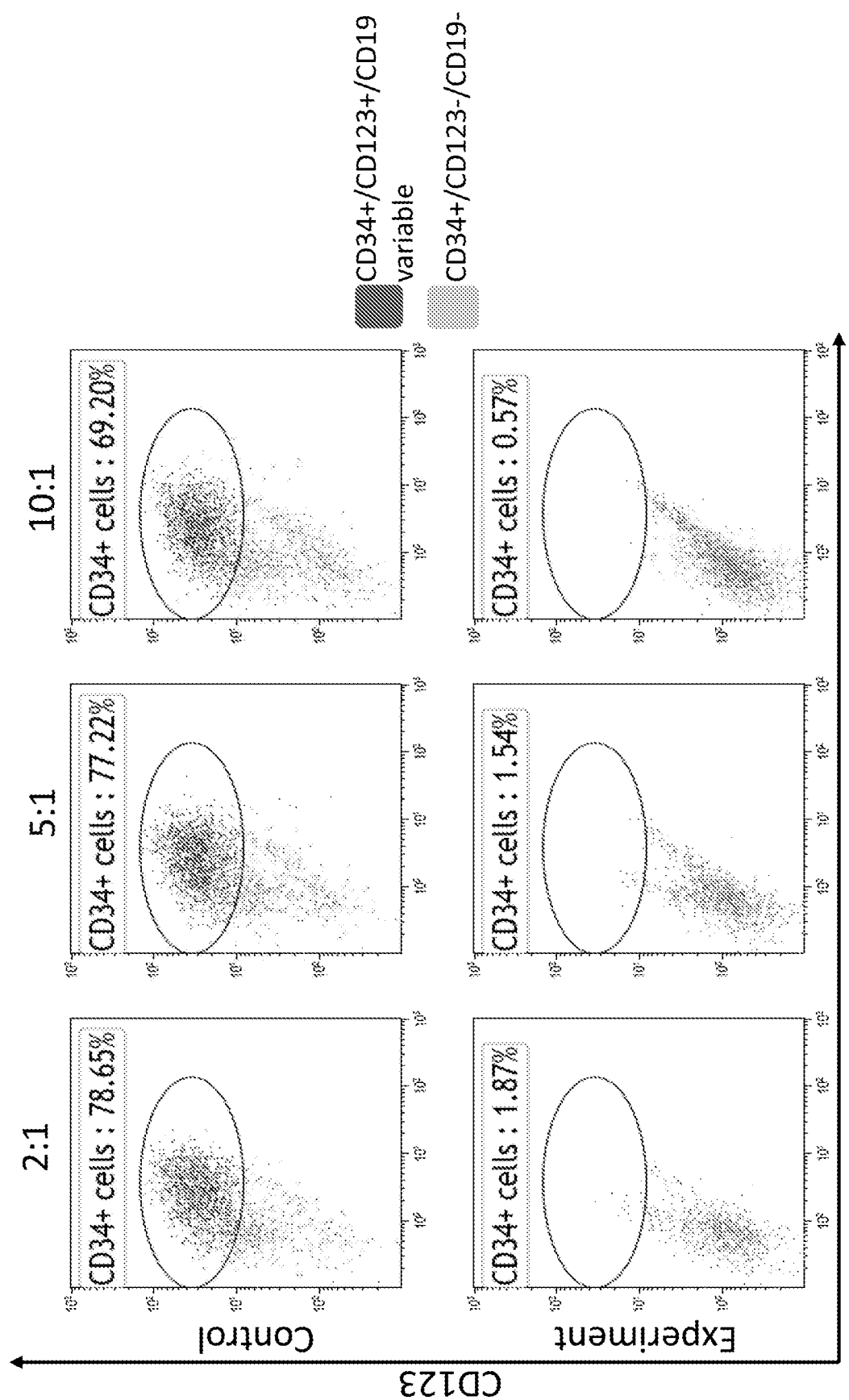

FIG. 91J. CD123b-CD33b-2G cCAR T-cells are able to target and ablate human B-ALL primary cells expressing CD123. Depletion of CD34+/CD123+ Leukemic cells for cases of CD19CAR relapse. We conducted co-cultures using a CD123b-CD33b-2G cCAR construct to test for ablation of primary B-ALL cells. Co-cultures were conducted with varying E:T ratios (2:1 and 5:1 and 10: shown here) and stained with a combination of antibodies for population analysis. CD34, CD38, CD33, CD123, and CD19 markers were analyzed and cells of potential B-ALL relapse after CD19CAR treatment were isolated and shown as a mixture of CD19+ and CD19– cells (circled in blue) that were also CD34+/CD123+ by flow cytometry. Depletion of this population by cCAR T-cells shown in figure. Pink populations represent CD34+ cells, however, they are concurrently negative for CD123, CD19, and CD33. N=2 FIG. 91K. Remarkable efficacy of CD123b-CD33b-2G cCAR T-cells in ablating tumor cells. Co-cultures were set up at increasing E:T ratios from 0.25:1 effector:target cells through 10: E:T ratios. Co-cultures were incubated overnight and prelabeled with cytotracker (CMTMR dye) to separate tumor populations from effector cells. Flow cytometry analysis was conducted to assay depletion of target tumor cells.

FIGS. 91L-91M. CD123b-CD33b CAR T cells demonstrate anti-tumor effects in vivo against cell line expressing CD33 antigen. NSG mice were sublethally irradiated and intravenously injected with $1.0 \times 10^6$ luciferase-expressing U937 cells (Day 0) to induce measurable tumor formation. Starting 3 days after injection of tumor cells, mice were intravenously injected with a course of $10 \times 10^6$ CD123b-CD33b CAR T cells or vector control T cells. On days 3 and 6, mice were injected subcutaneously with RediJect D-Luciferin and subjected to IVIS imaging. (91L) Dorsal view; (91M) Ventral view.

FIGS. 91N-91O. CD123b-CD33b CAR T cells demonstrate anti-tumor effects in vivo against cell line expressing both CD33 and CD123 antigens. NSG mice were sublethally irradiated and intravenously injected with $1.0 \times 10^6$ luciferase-expressing U937 cells (Day 0) to induce measurable tumor formation. Starting 3 days after injection of tumor cells, mice were intravenously injected with a course of $10 \times 10^6$ CD123bCD33b CAR T cells or vector control T cells. On days 3 and 6, mice were injected subcutaneously with RediJect D-Luciferin and subjected to IVIS imaging. (91N) Dorsal view; (91O) Ventral view.

Figure 92:
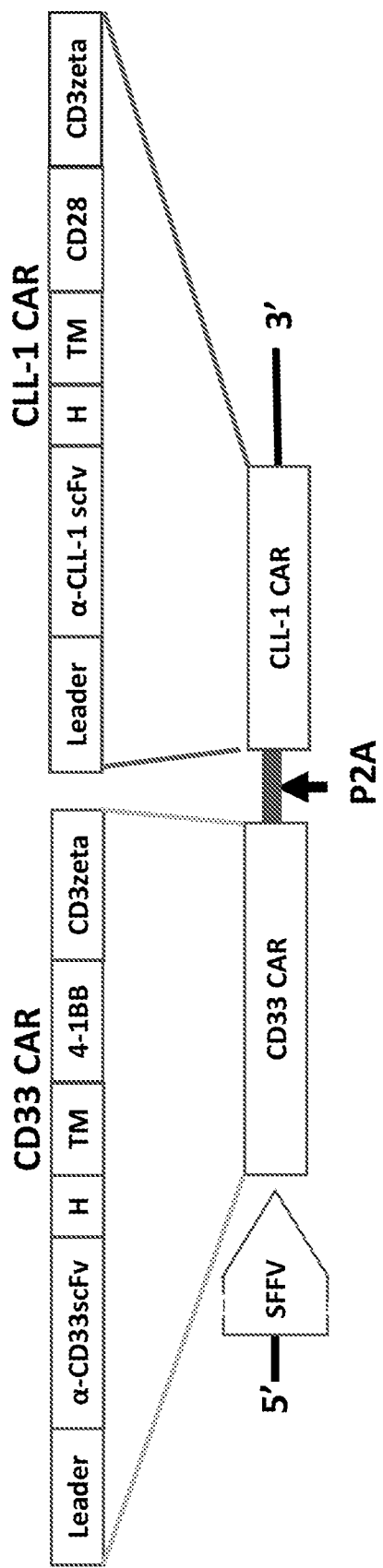

FIG. 92. A schematic representation of cCAR-T construct. The construct includes a SFFV promoter driving the expression of multiple modular units of CARs linked by a P2A peptide. Upon cleavage of the linker, the cCARs split and engage upon targets expressing CD33 and/or CLL-1. As a novel cCAR construct, the activation domains of the construct may include, but is not limited to, 4-1BB on the CD33 CAR segment and a CD28 region on the CLL-1 CAR segment.

Figure 93:
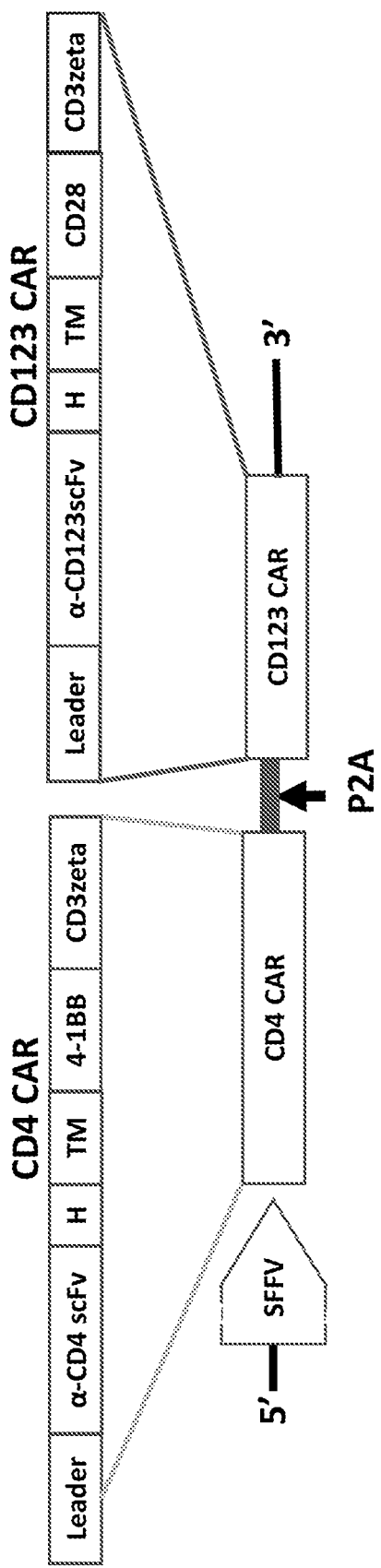

FIG. 93. A schematic representation of cCAR-T construct. The construct includes a SFFV promoter driving the expression of multiple modular units of CARs linked by a P2A peptide. Upon cleavage of the linker, the cCARs split and engage upon targets expressing CD4 and/or CD123. As a novel cCAR construct, the activation domains of the construct may include, but is not limited to, 4-1BB on the CD4 segment and a CD28 region on the CD123 CAR segment.

Figure 94A:
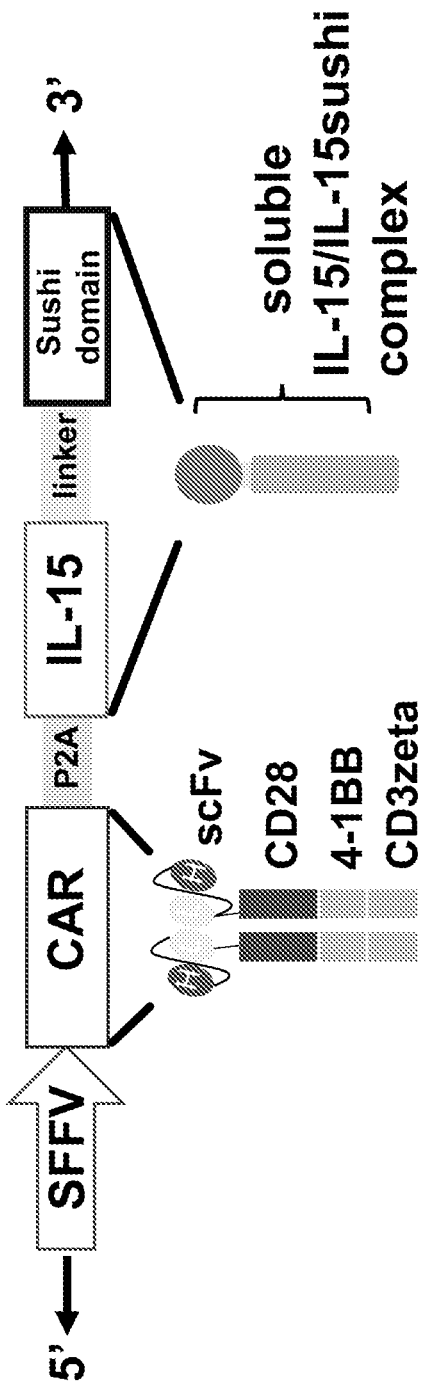
Figure 94B:
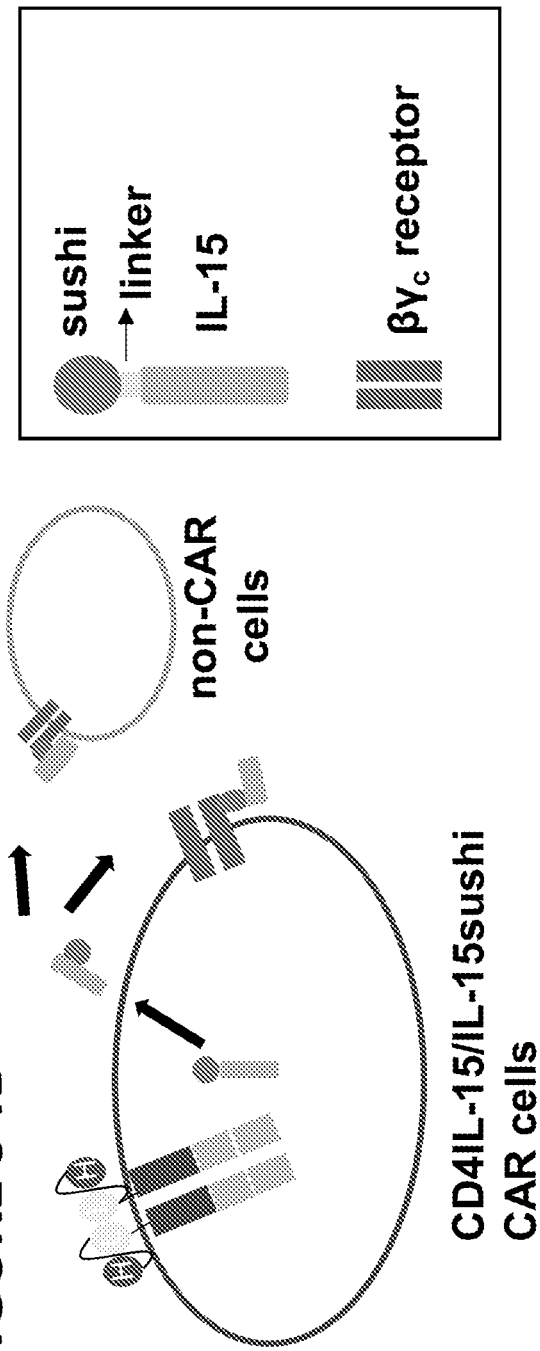

FIG. 94. Schematic diagram to elucidate the construct and its expression in T or NK cells. A) combination of a CAR, (including, but not limited to, third generation), and sushi domain of the IL-15 alpha receptor (called IL-15sushi), is assembled on an expression vector and their expression is driven by the SFFV promoter. CAR with IL-15/IL-15 sushi is linked with the P2A self-cleaving sequence. The IL-15/IL-15sushi portion is composed of IL-2 signal peptide fused to IL-15 and linked to sushi domain of IL-15 alpha receptor via a 26-amino acid poly-proline linker. B) CAR and IL-15/IL-15 sushi are present on the T or NK cells.

FIG. 95. A schematic showing a CAR equipped with IL-15/IL_15sushi anchor. A) the construct includes a SFFV promoter driving the expression of a CAR and an IL-15/IL-15sushi anchor (also called anchor) linked by a P2A peptide. Upon cleavage of this P2A peptide, IL-15/IL-15 anchor CAR splits to a CAR and an IL-15/IL-15sushi anchor. The IL-15/IL-15sushi portion of anchor is composed of IL-2 signal peptide fused to IL-15 and linked to sushi domain of IL-15 alpha receptor via a 26-amino acid poly-proline linker. Both CAR and anchor comprise a hinge (H) region, a transmembrane domain (TM). CAR also has scFv, costimulatory domain (including, but not limited to CD28 or 4-1BB) and intracellular signaling, CD3 zeta chain while anchor does not bear these components. B) IL-15/IL-15sushi is anchored on the surface of T or NK cells.

Figure 96A:
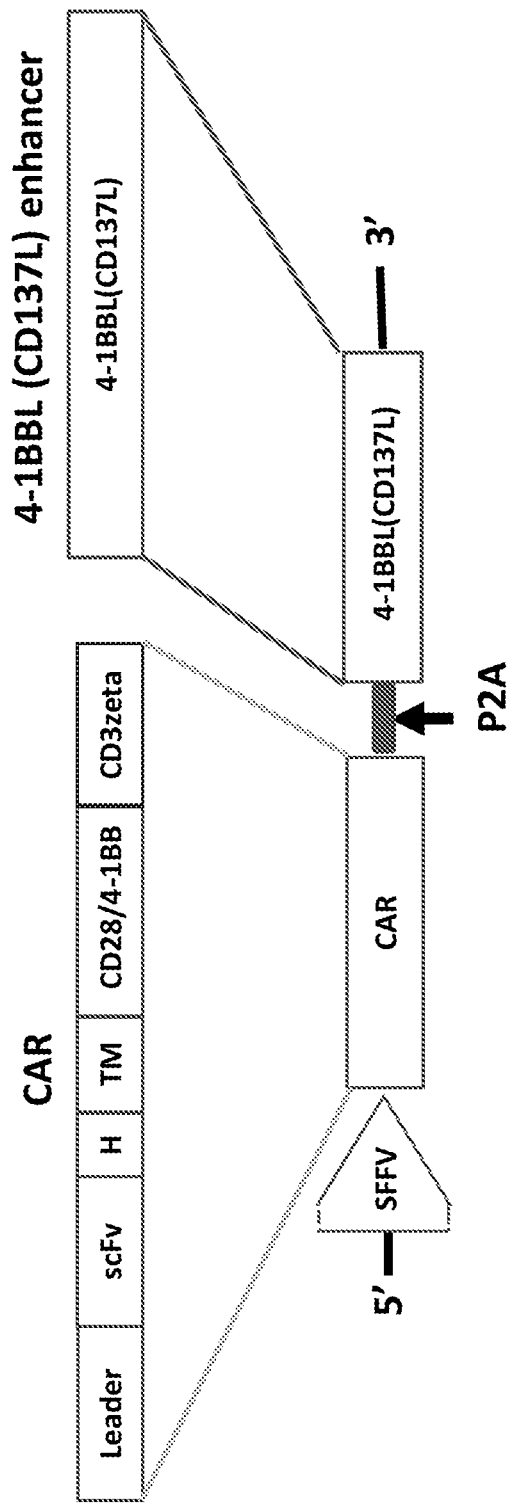

FIG. 96A. A schematic showing a CAR enhancer construct. The construct includes a SFFV promoter driving the expression of a CAR and an enhancer, 4-1BBL (CD137L) linked by a P2A peptide. Upon cleavage of this P2A peptide, A CAR construct with 4-1BBL splits to a CAR polypeptide and the full length of 4-1BBL protein. A CAR includes a leader sequence and scFv, a hinge (H) region, a transmembrane domain (TM). CAR also has costimulatory domain (including, but not limited to, CD28 or 4-1BB) and intracellular signaling, CD3 zeta chain while 4-1BBL does not bear these components. 4-1BBL provides a synergistic effect of T cell activation or anti-tumor activity with CD28 or 4-1BB (but not limited to)

Figure 96B:
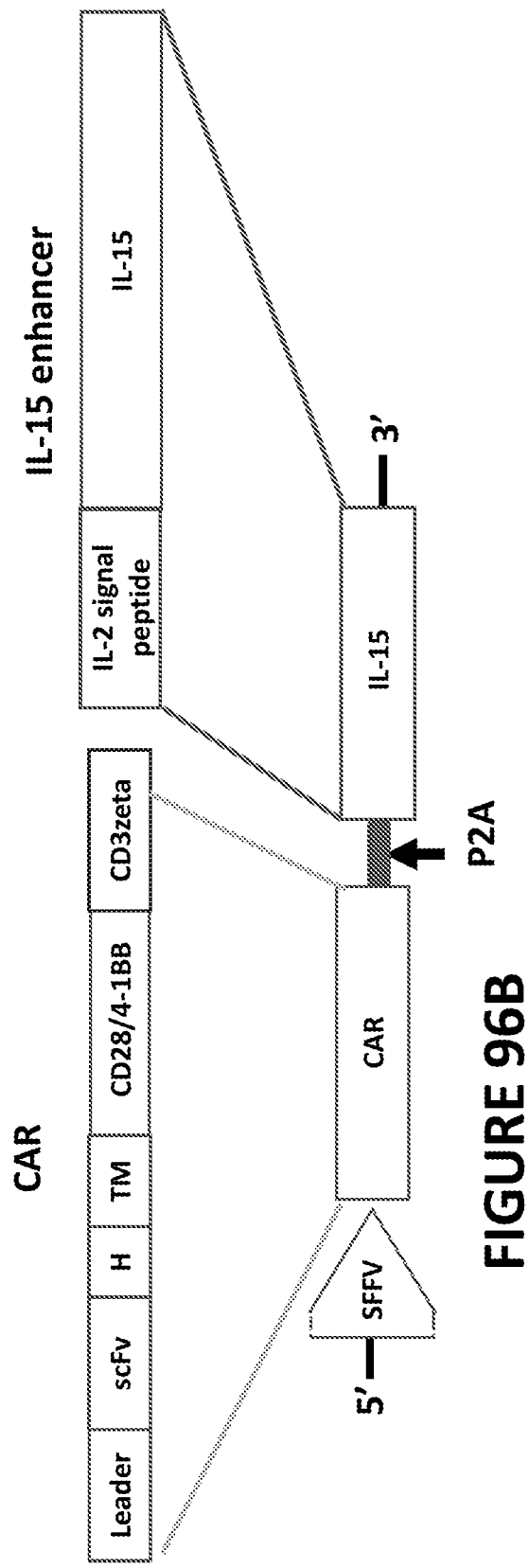

FIG. 96B. A schematic showing a CAR enhancer construct. The construct includes a SFFV promoter driving the expression of a CAR and an enhancer, IL-15 linked by a P2A peptide. Upon cleavage of this P2A peptide, A CAR construct with IL-15 splits to a CAR polypeptide and the full length of IL-15 protein. A CAR includes a leader sequence and scFv, a hinge (H) region, a transmembrane domain (TM). CAR also has a costimulatory domain (including, but not limited to, CD28 or 4-1BB) and intracellular signaling, CD3 zeta chain while IL-15 does not bear these components. IL-15 provides a synergistic effect of T cell activation or expansion or anti-tumor activity with CD28 or 4-1BB. The IL-15 signal peptide in the IL-15 is replaced with IL-2 signal peptide (leader sequence), a strong signal peptide to provide a high efficiency of IL-15 secretion.

Figure 97A:
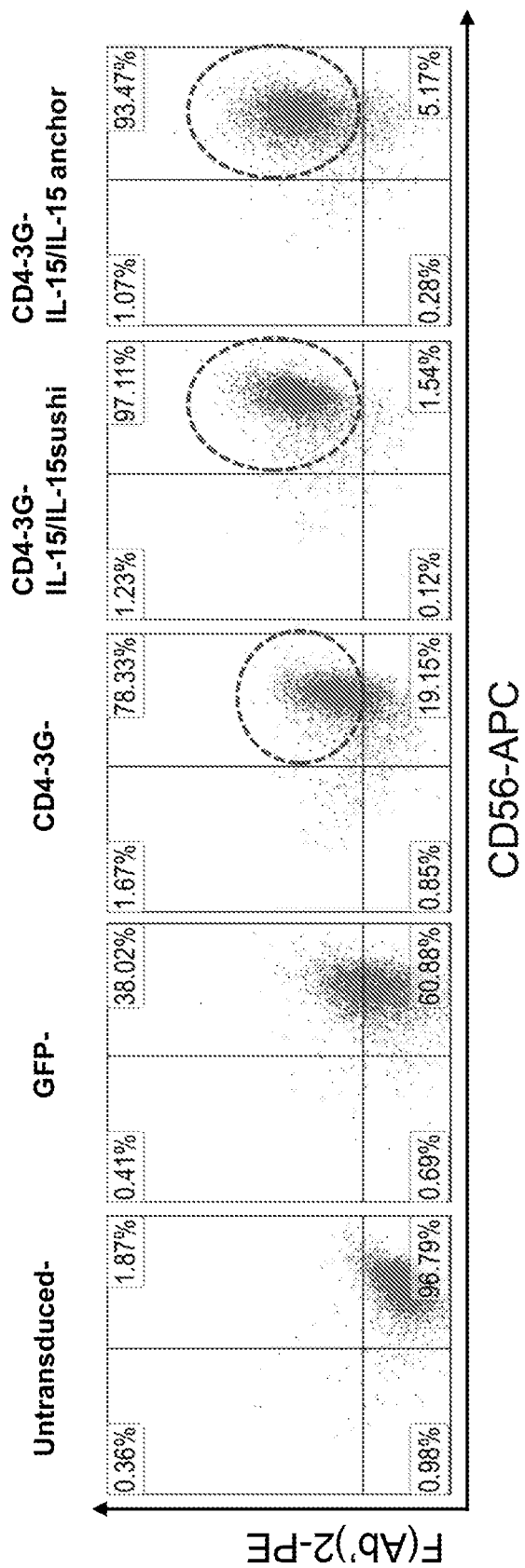

FIG. 97A. Generation of CD4-3G-IL-15/IL-15suhi- and CD4-3G-IL-15/IL-15sushi anchor and their expression in NK92 cells on NK92 cells by FACS analysis. CD4-3G, CD4-3G-IL-15/IL-15 sushi- and CD4-3G-IL-15/IL-15 anchor (CD4-3G-IL-15/IL-15 sushi anchor) CAR lentiviruses were used to transduce NK92-cells and their surface CAR expression (circled in blue on upper row panels) was sorted and determined by flow cytometry analysis with F(Ab')2 surface staining and CD56 antibody staining compared to untransduced- or GFP-transduced NK92 cells (negative controls). CAR expression levels were shown in CD4-3G- (78.3%), CD4-3G-IL-15/IL-15sushi (97.1%) or CD4-3G-IL-15/IL-15 anchor (93.4%) CAR in transduced NK92 cells compared to untransduced-NK92 cells.

Figure 97B:
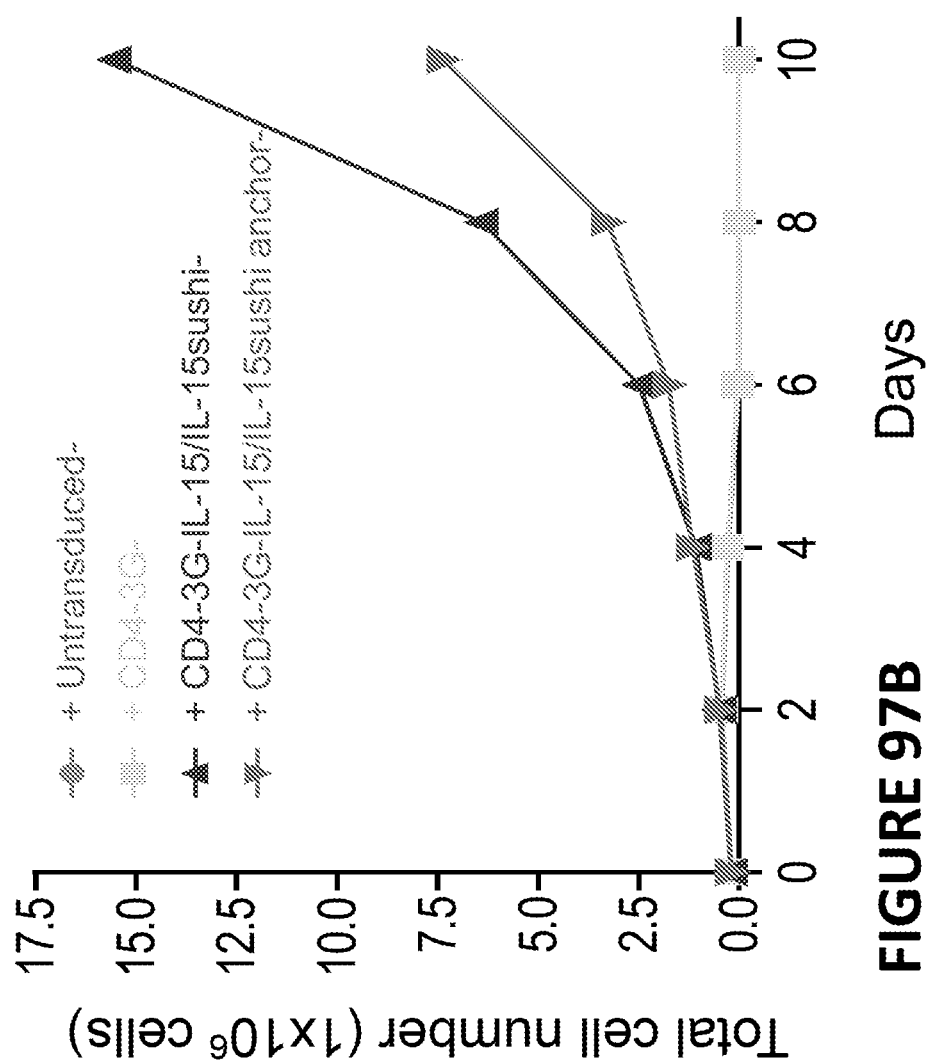
Figure 97C:
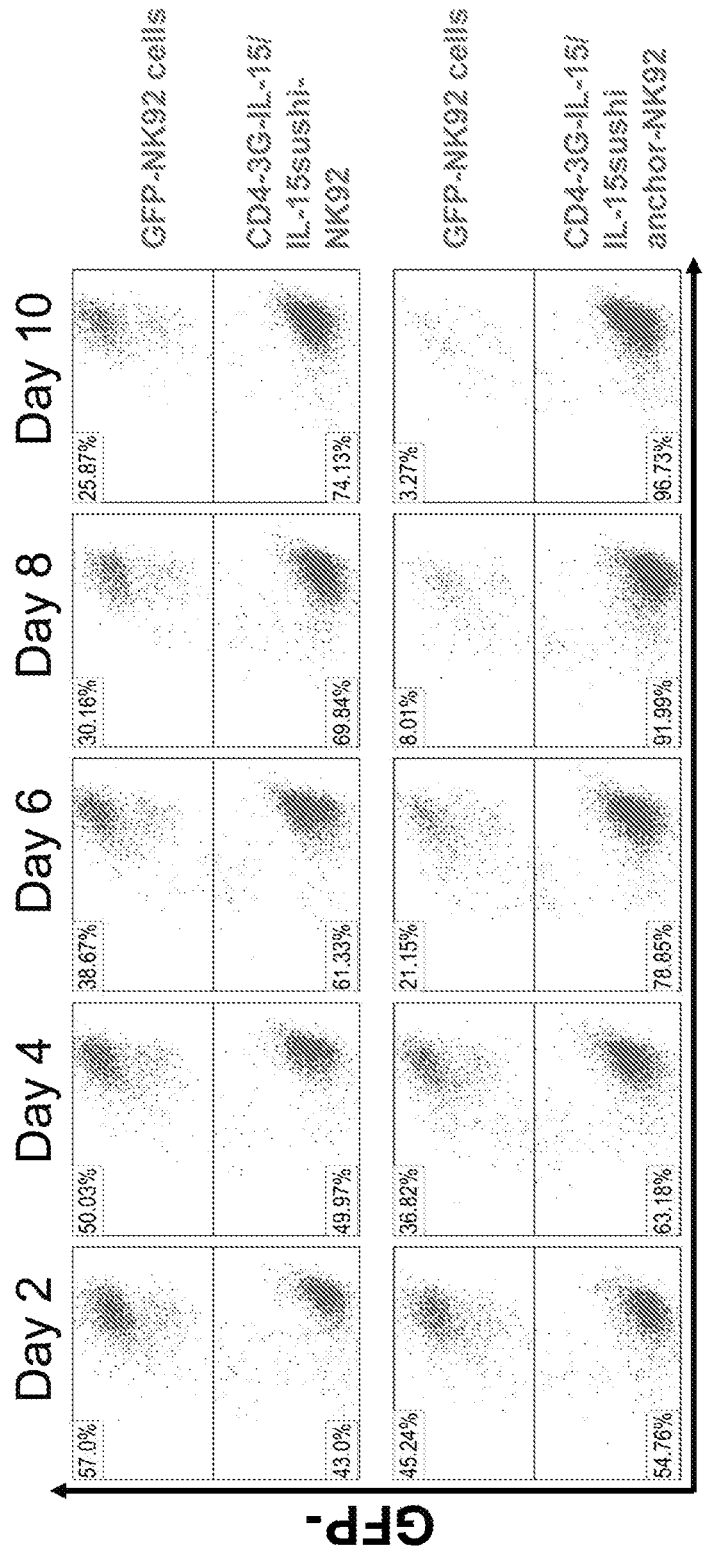
Figure 97D:
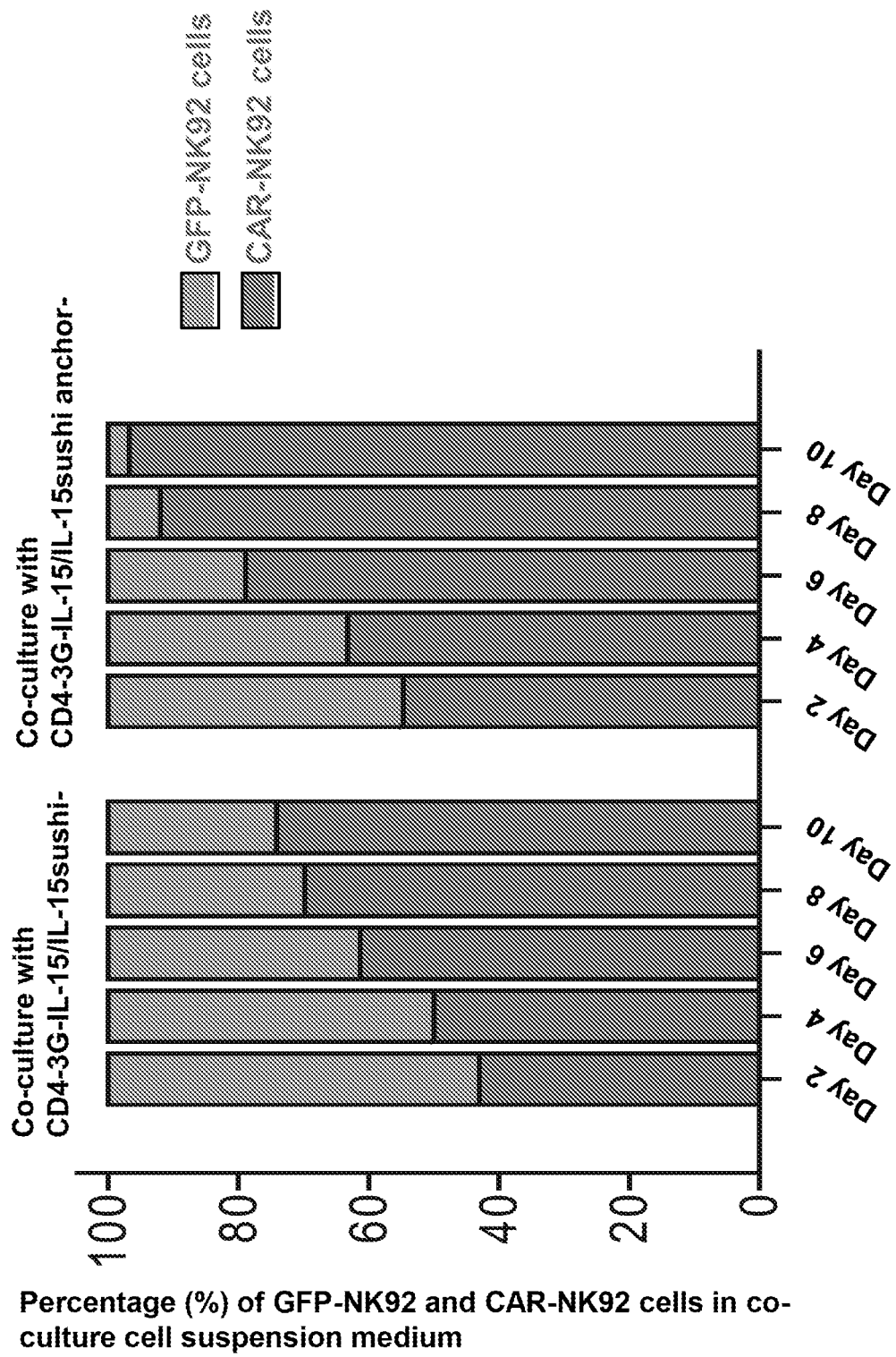

FIGS. 97B, and 97D. Compare the effect of secreting IL-15/IL-15sushi and IL-15/IL-15sushi anchor on CAR and non-transduced neighboring cells using a co-culture assay. Sorted NK92 cells stably transduced with CD4-3G-IL-15/IL-15sushi or CD4-3G-IL15/IL-15 anchor CAR (see FIG. 97A) can expand at a similar rate in the absence of IL-2 as compared to NK92 cells stably transduced with CD4-3G CAR or GFP lentiviruses, which could not grow (data not shown). This study pin-points the importance of co-expression functional complex of IL-15/IL-15sushi or IL-15/IL-15 anchor in promoting CAR transduced-NK-92 cell growth. FIG. 97B Co-culture cell growth analysis using GFP-NK92 cells and CD4CARs-NK92 cells without adding IL-2 in cell culture medium. We then tested effect of secreting IL-15/IL-15sushi and IL-15/IL-15sushi anchor on non-transduced neighboring cells. Sorted NK-92 cells stably expressing CD4-3G or CD4-3G-IL-15/IL-15sushi or CD4CAR-3G-IL-15/IL-15sushi anchor CAR were mixed in a 50:50 ratio with GFP+NK-92 cells. These cells were co-cultured either with IL-2 added or no IL-2. Total cell counts calculated throughout the experiment (up to Day 10) for NK-92 cells co-cultured with or without IL2. Co-culture CD4-3G or CD4-3G-IL-15/IL-15sushi anchor CAR-transduced or GFP-NK92 cells exhibits less proliferation compared to co-cultured with CD4-3G-IL-15/IL-15sushi CAR-NK92 cells. FIG. 97C, FACS analysis of percentage of GFP-NK92 cells in co-cultured with CD4CAR-3G-IL-15/IL-15sushi-transduced or CD4CAR-3G-IL-15/IL-15sushi anchor-NK92 cells in a day dependent manner. Flow cytometry analysis is used to compare the effect of secreting IL-15/IL-15sushi and IL-15/IL-15sushi anchor on CAR and non-transduced neighboring cells. The percentage of GFP+NK cells is significantly reduced to the background level (3.27%) when co-cultured with CD4-3G-IL-15/IL-15sushi anchor CAR-transduced-NK92 cells while the percent of GFP+NK cells remained a high level (25.87%). FIG. 97D, Percentage ratio of GFP-NK92 cells in co-cultured with CD4CAR-3G-IL-15/IL-15sushi-transduced or CD4CAR-3G-IL-15/IL-15sushi anchor-NK92 cells in a day dependent manner. Summarize the effect of secreting IL-15/IL-15sushi and IL-15/IL-15sushi anchor on CAR and non-transduced neighboring NK92 cells by flow cytometry analysis. GFP+NK92 cells showed significantly prolonged survival in co-cultured in the absence of IL-2 when co-culture with CD4-3G-IL-15/IL-15sushi CAR-transduced NK-92 compared to CD4-3G-IL-15/IL-15sushi anchor CAR-NK92. These studies indicate that secreting IL-15/IL-15sushi complexes have a profound effect on CAR cells and their neighboring non-CAR cells. In contrast, IL-15/IL-15sushi anchor had a similar effect on CAR cells to secreting IL-15/IL-15sushi but its effect on neighboring non-CAR cells were limited.

Figure 97E:
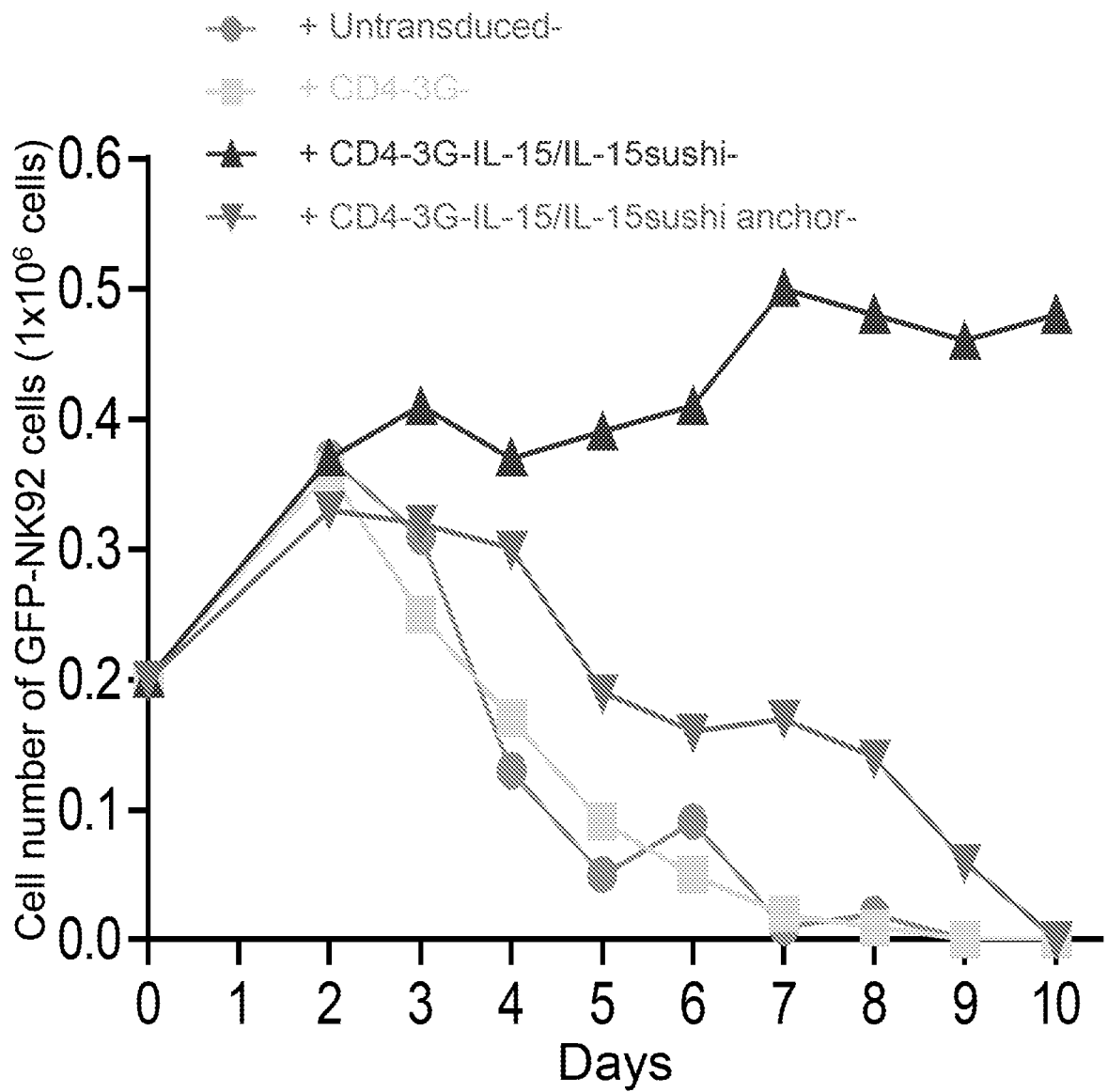

FIG. 97E. Cell growth analysis of co-cultured GFP-NK92 cells with CD4CARs-NK92 cells using transwell co-culture assay without IL-2 in cell culture medium. Compare the effect of secreting IL-15/IL-15sushi and IL-15/IL-15sushi anchor on CAR and non-transduced neighboring cells using a chamber (transwell) culture assay. To further determine if this effect was due to secreted protein alone, or an interaction between co-cultured cells, we devised an experiment in which the GFP NK92 cells were cultured in a chamber below the cultured CD4-3G or CD4-3G-IL-15/IL15sush or CD4-3G-IL-15/IL-15sush anchor CAR NK92 cells, or non-transduced NK92 cells. In this situation, only proteins and not cells could pass between the membrane separating the two cultures. The number of GFP-NK92 cells in the absence of IL-2 were counted from Day 2 to Day 10. While GFP NK92 cells in the upper chamber above NK-92 cells or CD4-3G or CD4-30-IL-15/IL-15sush anchor CAR transduced NK-92 cells had died by Day 10, the GFP NK 92 cells above the CD4-IL-15/IL-15sushi CAR transduced NK92 cells had survived and expanded by Day 10, thereby indicating that it was the IL-15/IL-15sushi protein secreted by the CD4-3G-IL-15/IL-15sushi NK92 cells which had kept them alive, and not direct cell-to-cell contact. In this model, the upper chamber represents the tumor microenvironment, in which the survival of T cells or NK cells is improved by the secretion of IL-15/IL-15sushi from the CD4-3G-IL-15/IL-15 sushi NK cells. IL-15/IL-15 anchor had a profound effect on the transduced NK92 cell growth with less extent of direct cell-to-cell interact on non-transduced neighboring cells. In other words, IL-15/IL-15 anchor had a limited effect on non-transduced neighboring cells.

Figure 97F:
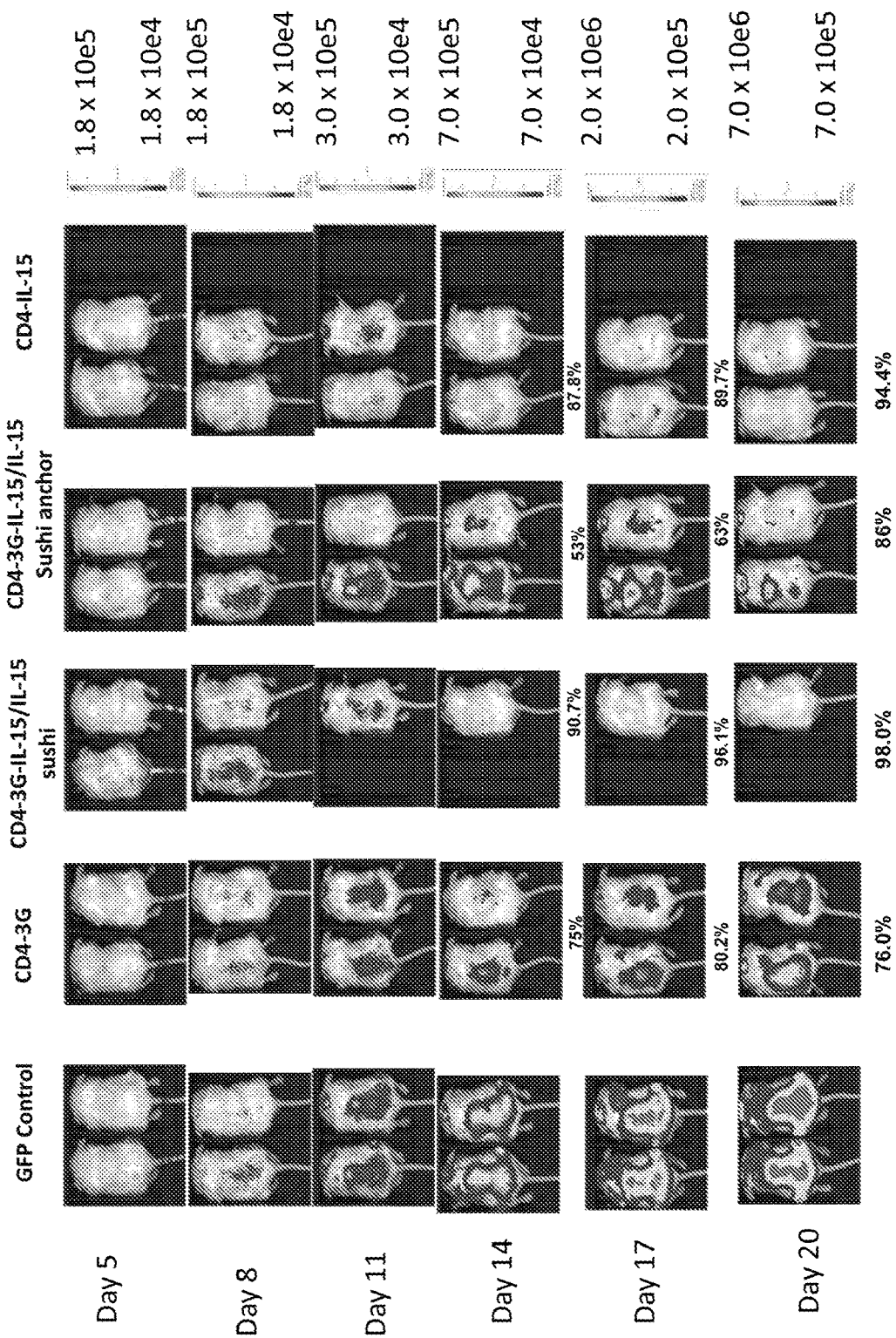

FIG. 97F. Compare the effect of secreting IL-15/IL-15sushi, IL-15/IL-15sushi anchor and secreting IL-15 on CAR efficacy in vivo. Luciferase-expressing Jurkate cells ($1\times10^6$ cells) were injected intravenously (day 1) at 24 h later after sub-lethal irradiation. About 50% Jurkate cells expressed CD4. On days 6 and 9, 5×10⁶ control GFP-, CD4-3G-, CD4-3G-IL15/IL-15sush, IL-15/IL-15sushi anchor and secreting IL-15 (with IL-2 signal peptide) CAR-NK92 cells were intravenously injected into each mouse (n=2 for each group). One CD4-3G-IL-15/IL-15sushi NK92 treated mouse was dead due to injection procedure (clumps of NK92 cells). All CD4-3G CARs equipped with IL-15/IL-15shshi, CD4-3G-IL-15sush anchor and IL-15 (with IL-2 signal peptide) did demonstrate more potent anti-leukemic effects on Jurkat cells than GFP or CD4-3G control based on IVIS analysis. Among these CARs, CD4-3G CAR equipped with IL-15/IL-15 sushi provided a better efficacy than other versions of CD4-3G CARs based on IVIS analysis. Interestingly, CD4-3G-IL-15/IL-15sushi anchor-NK92 treated mice showed gradually less tumor burden. The % number indicates % tumor reduction compared to GFP control.

Figure 98A:
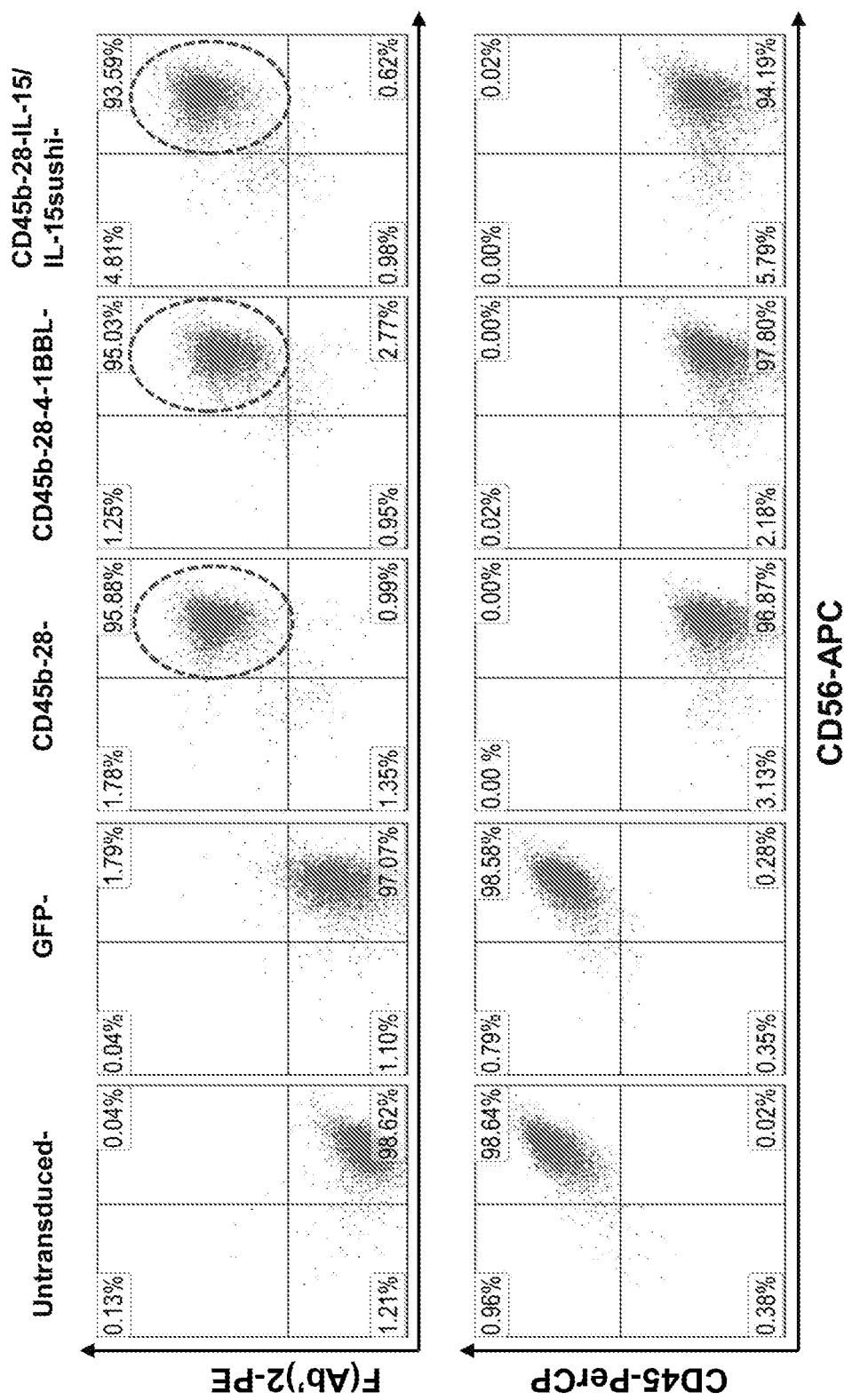

FIG. 98A. Generation of CD45b-28-4-1BBL-NK92 and CD45b-28-IL-15/IL-15sushi-NK92 cells. CD45b-28 CAR were generated and described above (FIGS. 57D and 57E) and this CAR equipped with 4-1BBL (CD45b-28-4-1BBL) and IL-15/IL-15sushi (CD45b-28-IL-15/IL-15sushi). CD45b-28, CD4-3G-4-1BBL and CD45b-28-IL-15/IL-15sushi-CAR lentiviruses were used to transduce NK92-cells and their surface CAR expression (circled in blue on upper row panels) was sorted and determined by flow cytometry analysis with F(Ab')2 surface staining and CD56 antibody staining compared to untransduced- or GFP-transduced NK92 cells (negative controls).

Figure 98B:
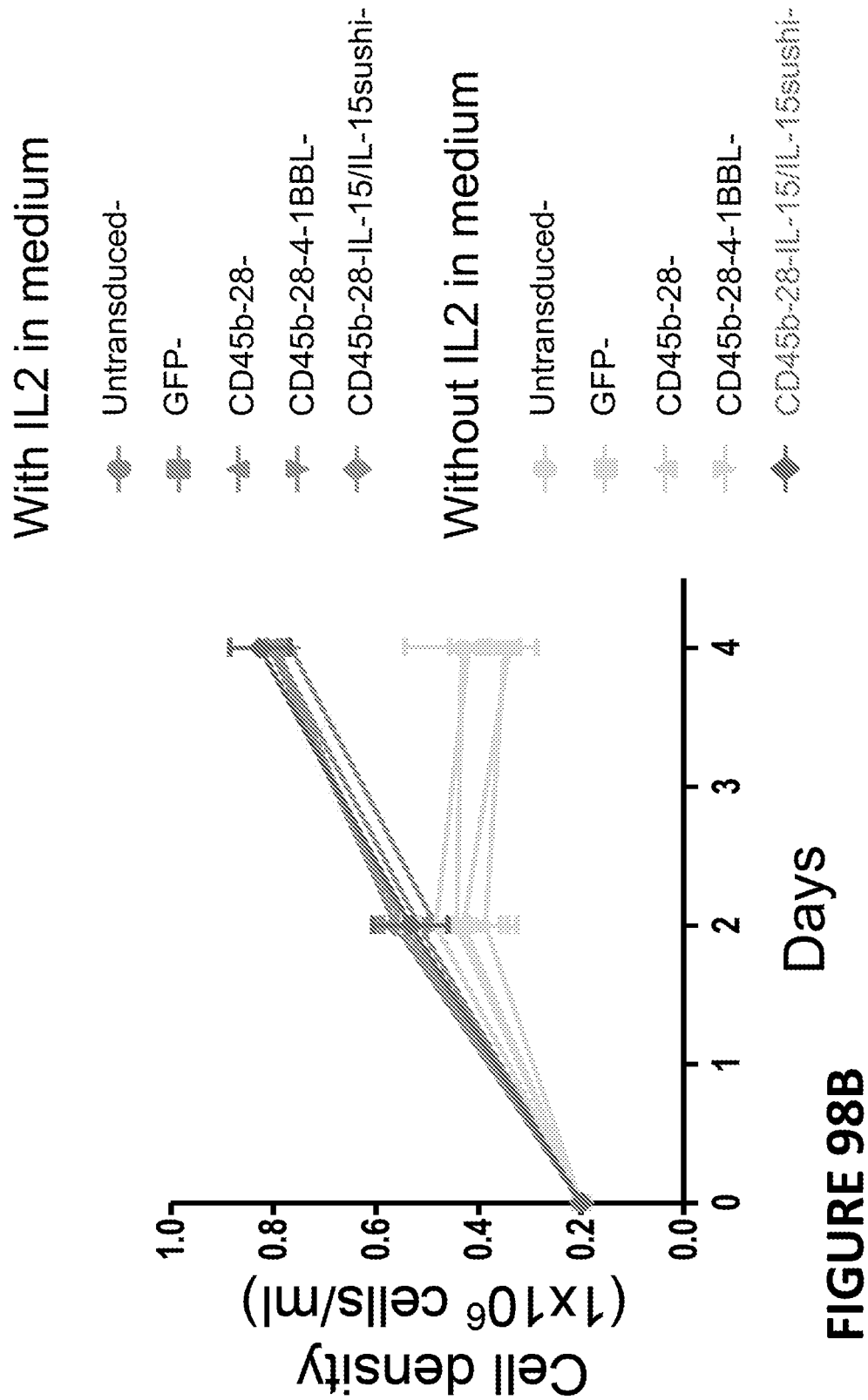

FIG. 98B. Cell growth analysis of CD45b-28-IL-15/IL-15suhi-NK92 cells in the presence or absence of exogenous IL2 in cell culture medium. Comparing the effect of secreting IL-15/IL-15/IL-15sushi complex or co-expression of 4-1BBL on NK-92 cell growth. CD45b-28 CAR is equipped with IL-15/IL-15sushi (CD45b-28-IL-15/IL-15sush) or 4-1BBL (CD45b-28-4-1BBL). The cellular growth curves of untransduced-, GFP-transduced-, sorted CD45b-28-, sorted CD45b-28-IL-15/IL-15sushi or sorted CD45b-28-4-1BBL transduced NK92-cells are compared in the absence of IL-2 or presence of IL-2. There was no significant difference in the cell growth between sorted NK92 cells stably transduced with CD45b-28-IL-15/IL-15sushi in the absence and presence of IL-2.

However, NK92 cells stably transduced CAR equipped with 4-1BBL such as CD45b-28-4-1BBL were unable to grow in the absence of IL2. This study pin-points the importance issue that co-expression of 4-1BBL does not support the CAR transduced-NK-92 cell growth.

Figure 98C:
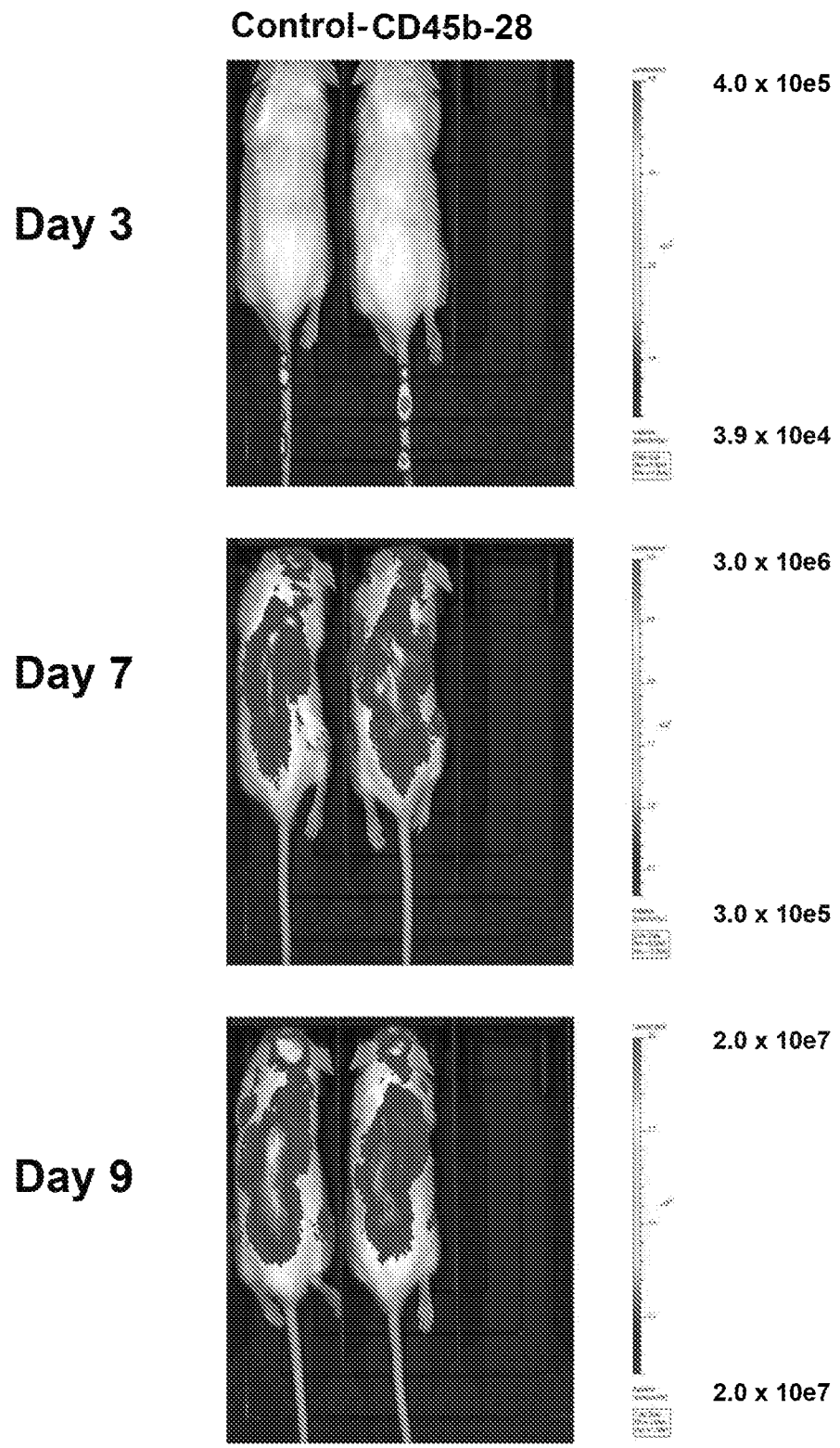
Figure 98D:
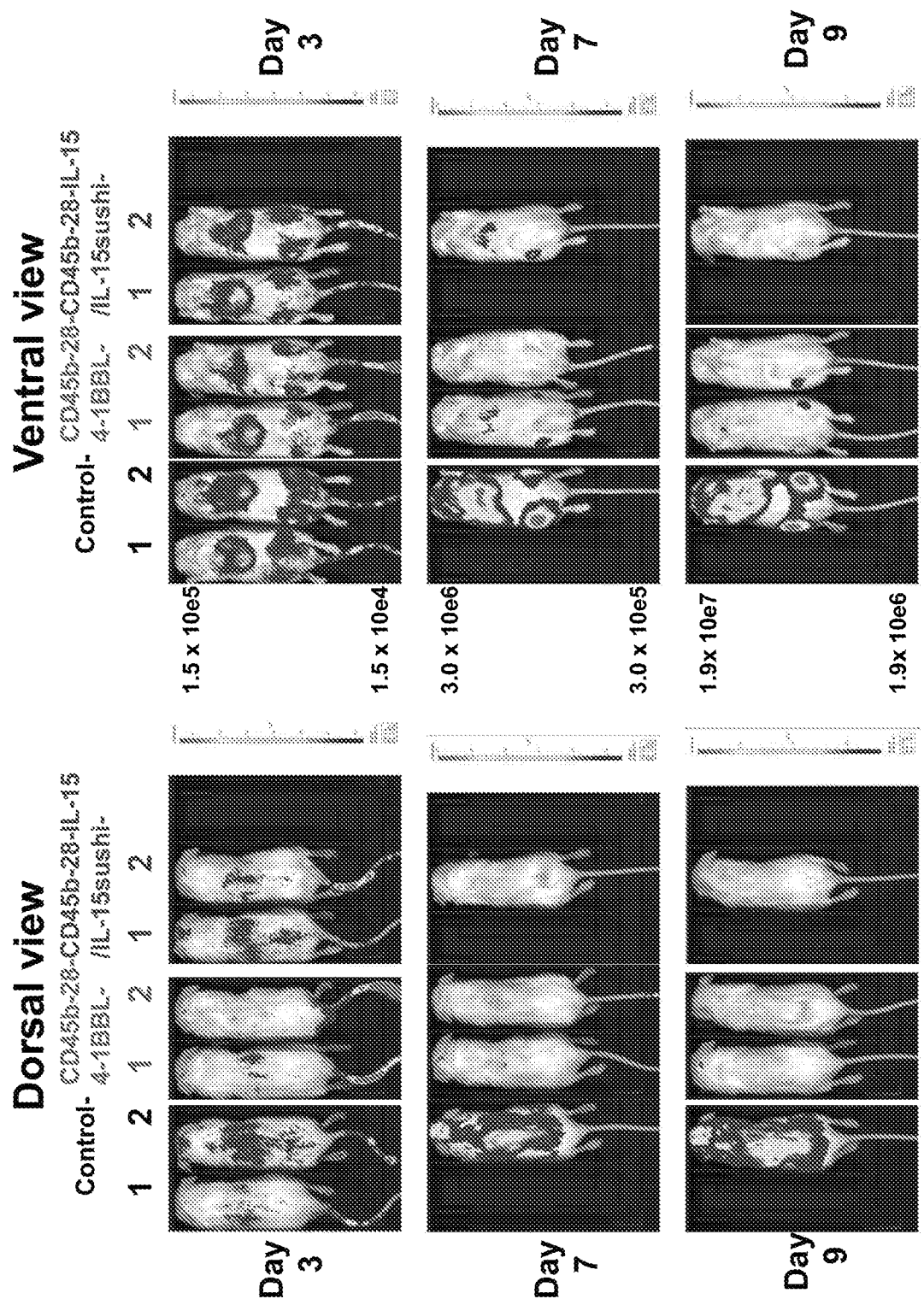
Figure 98E:
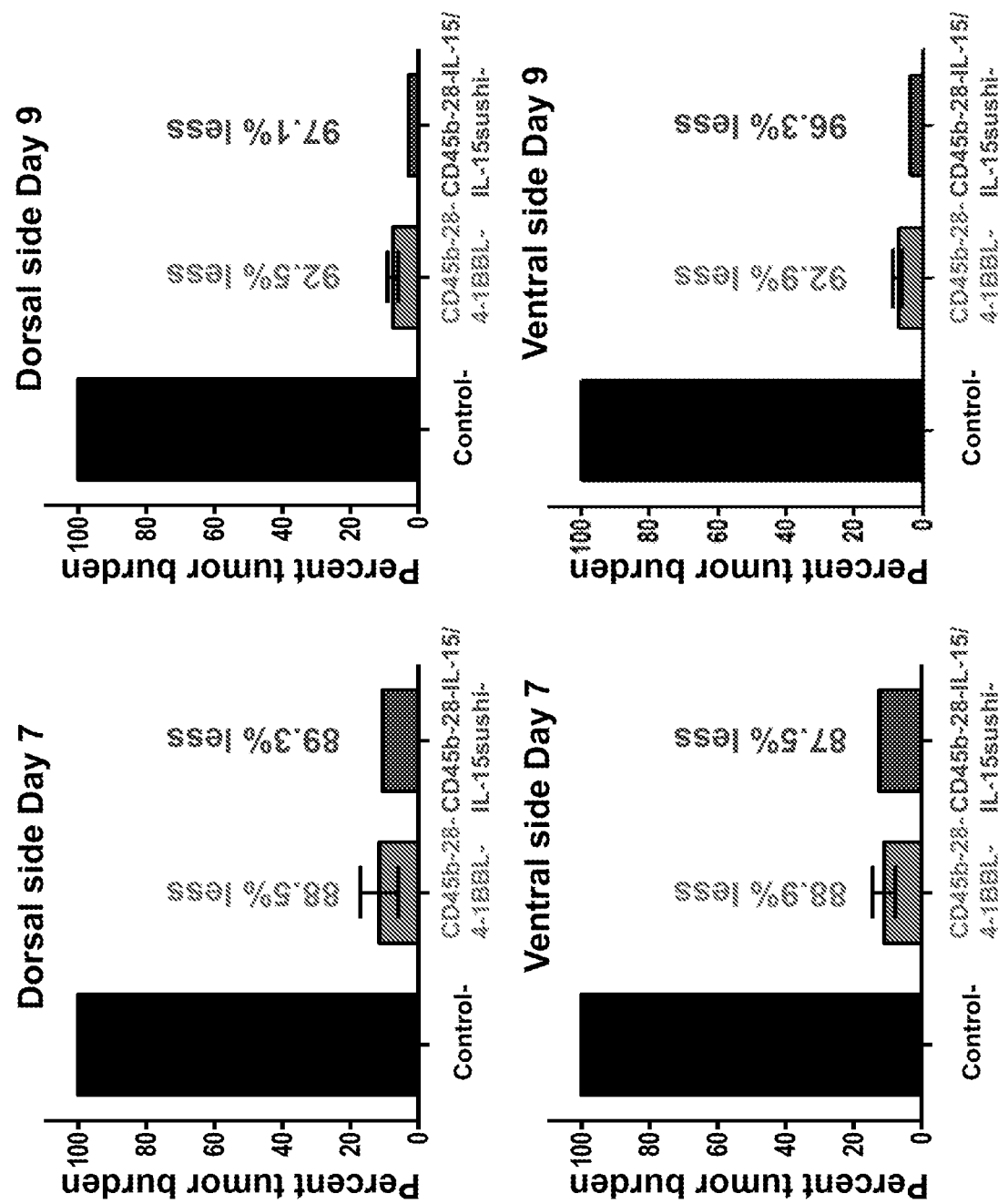

FIGS. 98C, 98D, and 98E. Comparing the effect of secreting IL-15/IL-15/IL-15sushi complex or co-expression of 4-1BBL on anti-tumor activity. Luciferase-expressing MOLM-13 cells (1×10⁶ cells) were injected intravenously (day 1) at 24 h later after sub-lethal irradiation. On days 4 and 5, 5×10⁶ control GFP-, CD45b-28-, CD45b-CAR-28-4-1BBL- or CD45b-28-IL-15/IL-15sushi CAR-NK92 cells were intravenously injected into each mouse (n=2 for each group). One control-NK92 treated mouse and one CD45b-28-IL-15/IL-15sushi NK92 treated mouse were dead due to injection procedure. FIG. 98C, CD45b-28-NK92 cells could not demonstrate significant anti-leukemic effect on the MOLM-13 (human acute monocytic leukemia) cell line in an in vivo xenograft mouse model. Tumor burden of dorsal side was measured using IVIS imaging system at days 3, 7 and 9. Both of control NK92 cells treated mice and CD45b-28 CAR NK92 treated mice did not show any difference in the tumor burden by IVIS imaging analysis. However, CD45b-28 CAR equipped with 4-1BBL (CD45b-28-4-1BBL) or IL-15/IL-15sushi CD45b-28-IL-15/IL-15 sushi) exhibited a robust and persistent anti-tumor activity in vivo (FIG. 98D). Tumor burden of dorsal side was measured using IVIS imaging system at days 3, 7 and 9. Both of control NK92 cells treated mice and CD45b-CAR-28-NK92 treated mouse did not show any difference in the tumor burden by IVIS imaging analysis. FIG. 98E, percent suppression of tumor burden (MOLM-13 cells) in mice treated with CD45b-28-4-1BBL- or CD45b-CAR-28-IL-15/IL-15sushi-NK92 cells relative to control at day 7 and day 9. Although 4-1BBL was unable to provide survival or expansion for NK-92 cells in vitro unlike secreting IL-15/IL-15sushi (FIG. 98B), 4-1BBL could exhibit as a powerful enhancer for CAR anti-tumor function in vivo (FIGS. 98D and 98E).

Figure 98F:
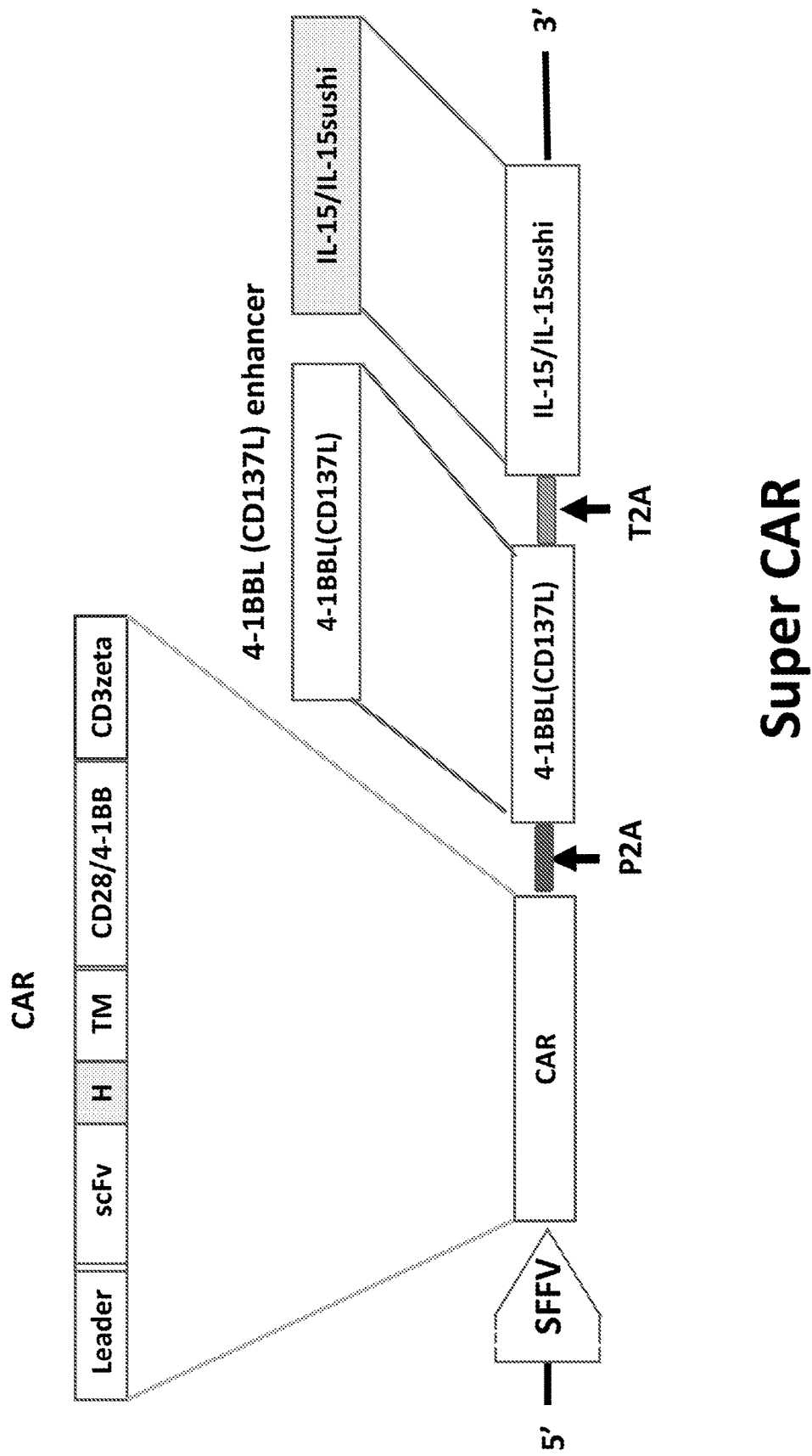

FIG. 98F. Links by P2A and T2A schematic to generate a super CAR showing a CAR equipped with 4-1BBL and IL-15/IL-15sushi in a single construct. The construct includes of a SFFV promoter driving the expression of three segments, CAR, 4-1BBL and IL-15/IL-15sushi. Upon cleavage of the linkers (P2A and T2A), the CAR, 4-1BBL and IL-15/IL-15sushi split and engage upon a target (s). CAR has scFV, hinge region, transmembrane domain, costimulatory domain (including, but not limited to, CD28 or 4-1BB) and intracellular signaling, CD3 zeta chain. 4-1BBL or IL-15/IL-sushi or both provides a synergistic effect of T or NK cell activation and persistency or anti-tumor activity with CD28 or 4-1BB.

Figure 98G:
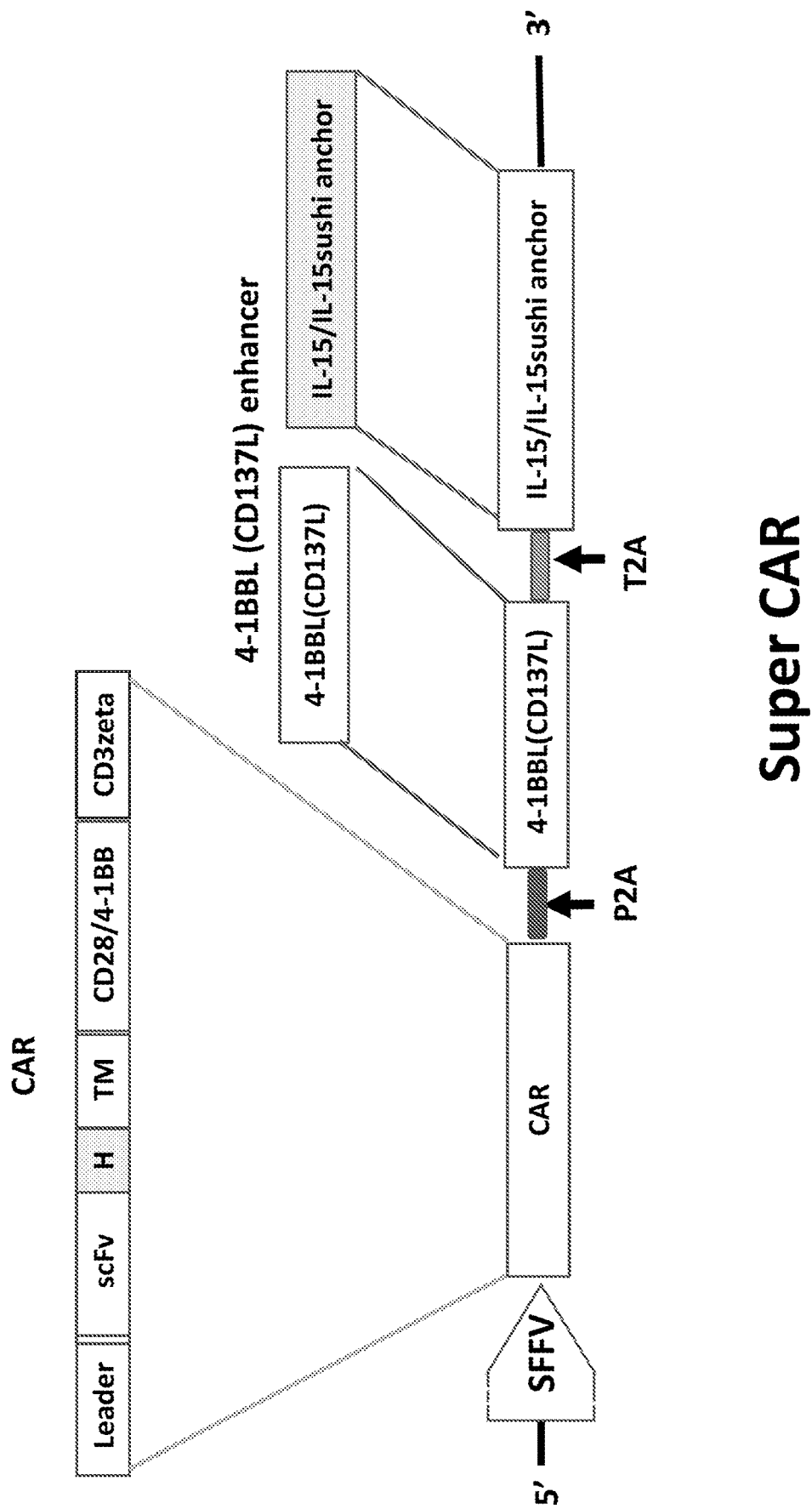
Figure 99A:
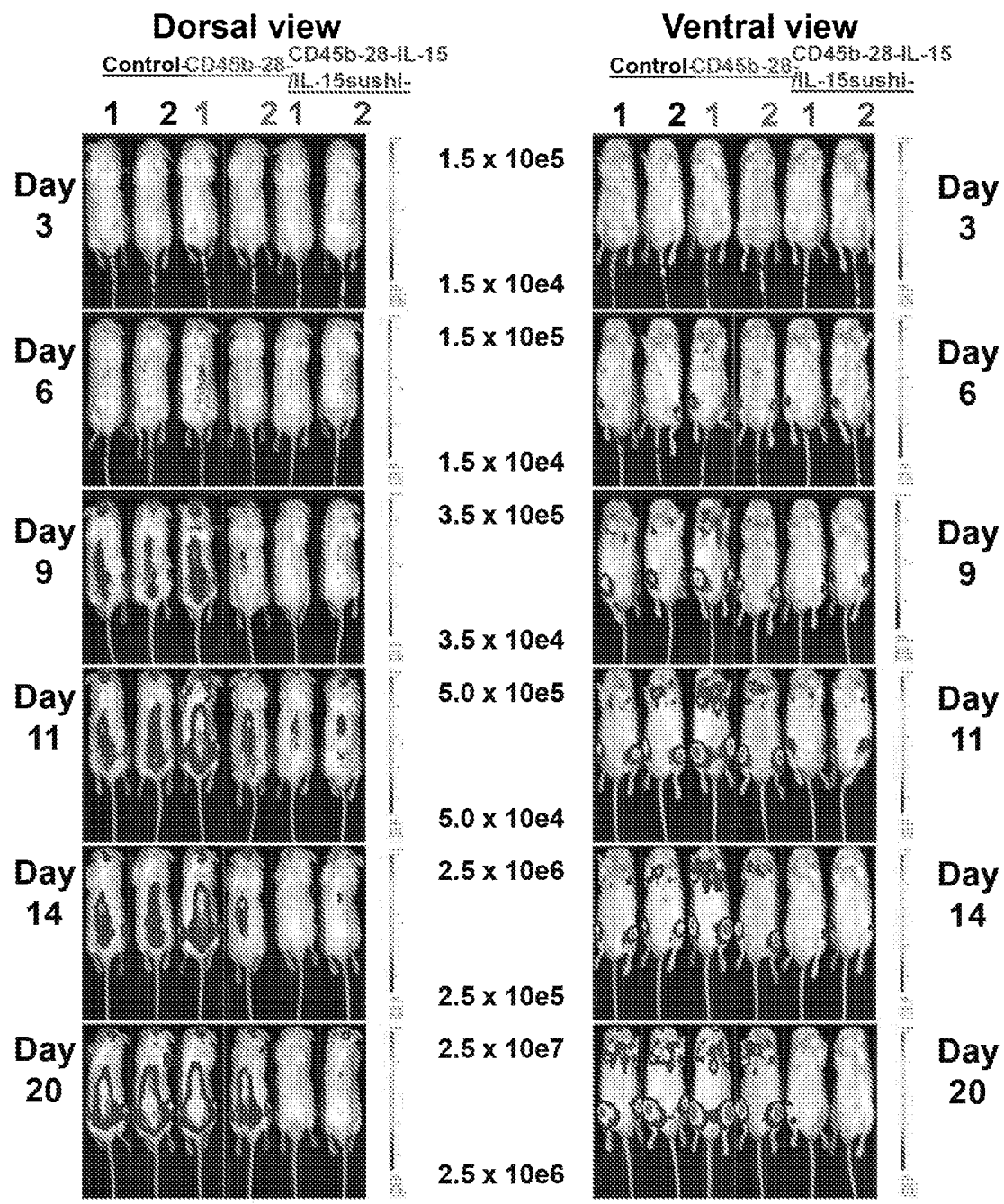
Figure 99B:
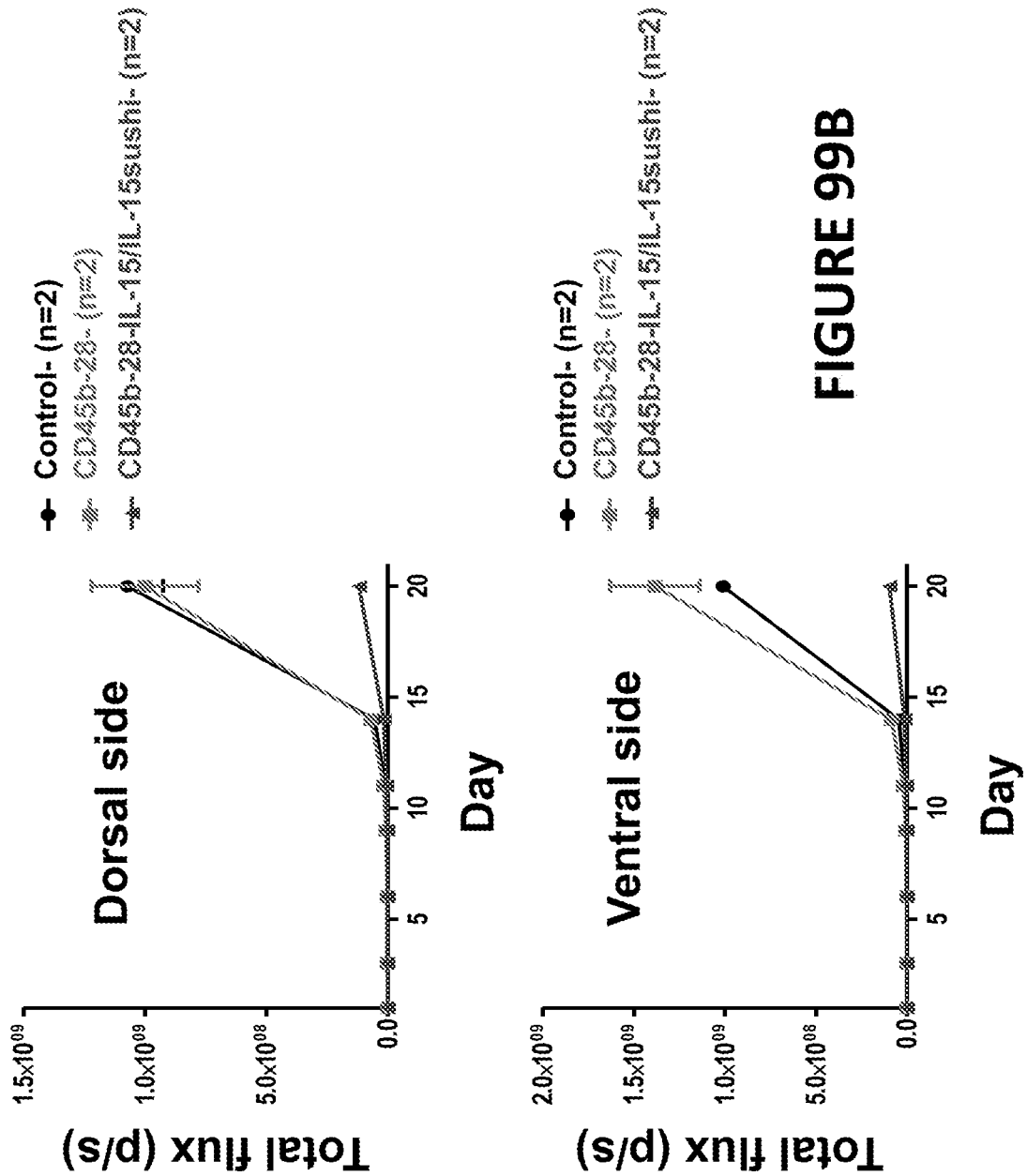

FIG. 98G. Links by P2A and T2A schematic to generate a super CAR showing a CAR equipped with 4-1BBL and IL-15/IL-15sushi in a single construct. The construct includes a SFFV promoter driving the expression of three segments, CAR, 4-1BBL and IL-15/IL-15sushi. Upon cleavage of the linkers (P2A and T2A), the CARs, 4-1BBL and IL-15/IL-15sushi split and engage upon a target (s). A CAR has scFv, hinge region, transmembrane domain, co-stimulatory domain (including, but not limited to, CD28 or 4-1BB) and intracellular signaling, CD3 zeta chain. 4-1BBL or IL-15/IL-sushi or both provides a synergistic effect of T or NK cell activation and persistency or anti-tumor activity with CD28 or 4-1BB FIGS. 99A, 99B and 99C. 99A, CD45b-28-IL-15/IL-15sushi CAR-NK92 cells demonstrate a profound anti-leukemic effect on the Jurkat (human acute T cell leukemia) cell line in an in vivo xenograft mouse model. luciferase-expressing Jurkat cells (1×10⁶ cells) were injected intravenously (day 1) at 24 h later after sub-lethal irradiation. On days 4 and 7, 5×10⁶ control GFP-CD45b-28- or CD45b-28-IL-15/IL-15sushi CAR NK92 cells were intravenously injected into each mouse (n=2 for each group). Tumor burden of dorsal side and ventral side was measured using IVIS imaging system at days 3, 6, 9, 11, 14 and 20. Compared to control NK92 cells or CD45b-28 CAR NK92 cells treated mice, CD45b-28-IL-15/IL-15sushi CAR NK92 cell treated mice had much less tumor burden. FIG. 99B, comparison of total flux values (photons/sec) among control-, CD45b-28- or CD45b-28-IL-15/IL-15sushi CAR NK92 cell treated mice against anti-leukemic effect on Jurkat (human acute T cell leukemia) cell line in an in vivo xenograft mouse model. Total flux levels in both of dorsal and ventral side were increased in control NK92 cells (black line in graph) and CD45b-28-NK92 cells (red line in graph) treated mice in a time dependent manner. On the other hand, CD45b-28-IL-15/IL-15sushi CAR NK92 cells treated mice (blue line in graph) showed profoundly suppress tumor progression compared to control and CD45b-CAR-28-NK92 cells injected mice. FIG. 99C, percent suppression of tumor (Jurkat cells) in mice treated with CD45b-28 CAR or CD45b-28-IL-15/IL-15sushi CAR NK92 cells relative to control at day 9, 11, 14 and 20.

FIG. 100A—Expression of CD19b-IL15/IL15sushi CAR T-cells. Above schema showing organization of CD19b-IL-15/IL-15sushi. T-cells isolated from peripheral blood (PB) were transduced with lentivirus expressing either control or CD19b-IL15/IL15sushi constructs. Flow cytometry using CD3 and F(ab)' antibodies was done to assay the percentage transduction of the CAR and transduced populations are colored blue. N=2.

Figure 100B:
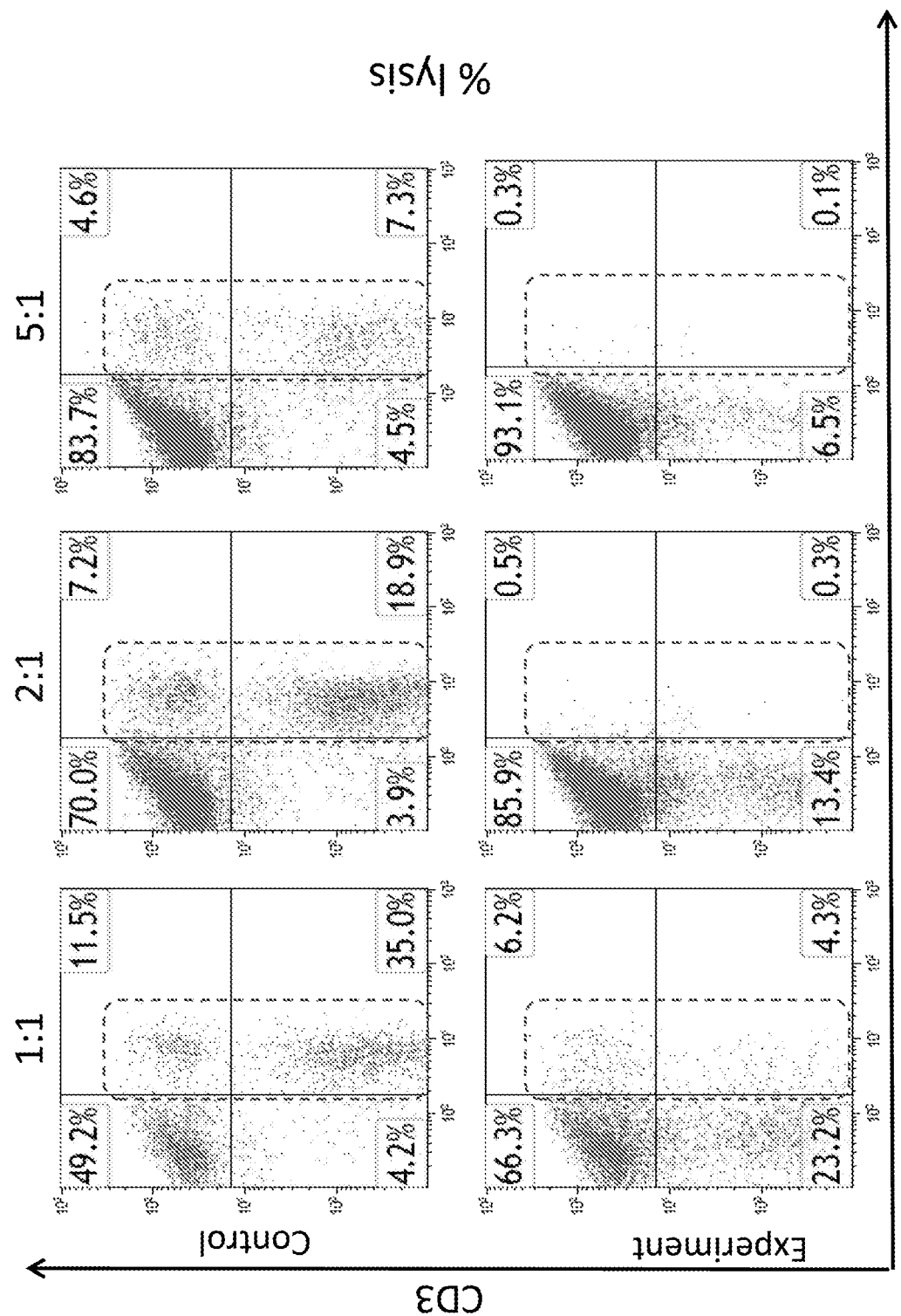

FIG. 100B. CD19b-IL15/IL15sushi CAR T-cells efficiently deplete CD19+Sp53 cells. CD19b-IL15/IL15sushi achieves potent lysis of Sp53 target cells. Co-culture experiments were performed at an effector to target ratio of spanning from 1:1 to 5:1 for 24 hours and were directly analyzed by flow cytometry with mouse anti-human CD3pPerCp and mouse anti-human CD19-PE. Each assay includes target cells (Sp53 all CD19+) incubated with either control or CAR T-cells. N=2.

Figure 100C:
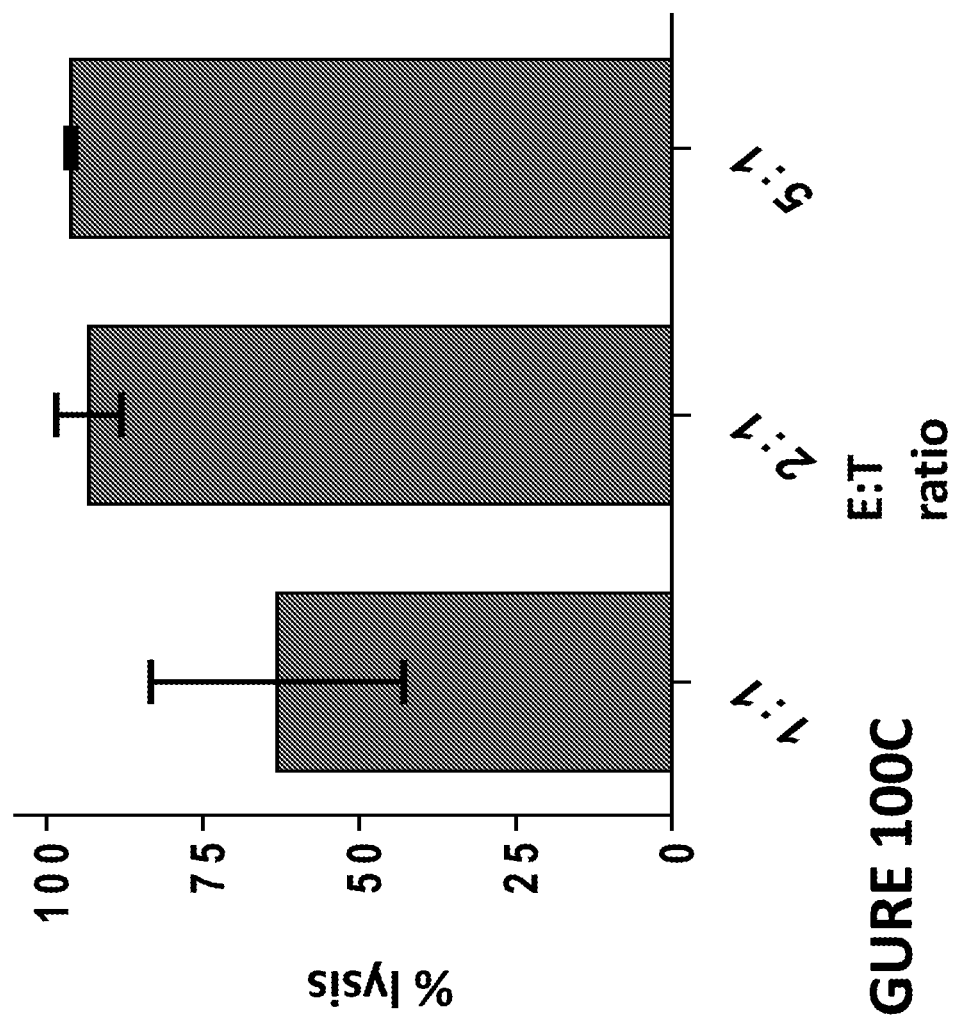

FIG. 100C. Bar graph summarizing cytotoxic activity from results of FIG. 100B.

Figure 101A:
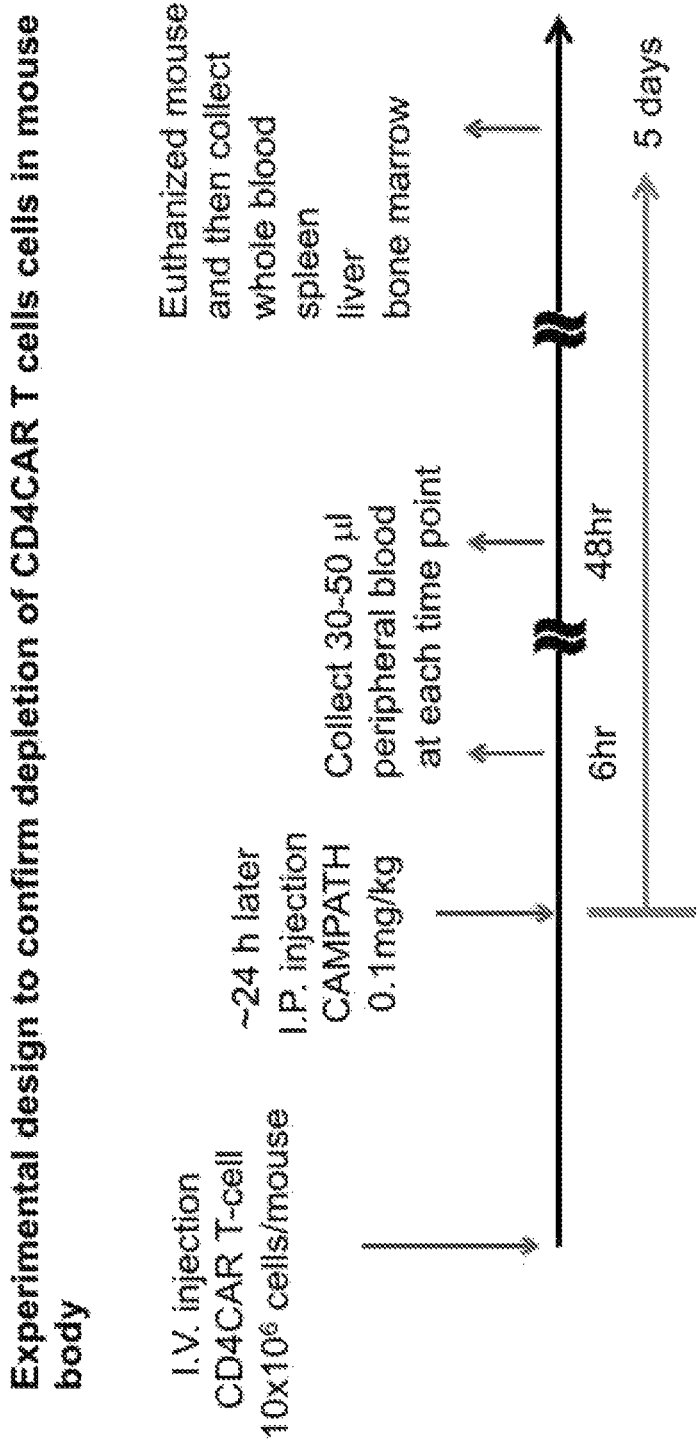
Figure 101B:
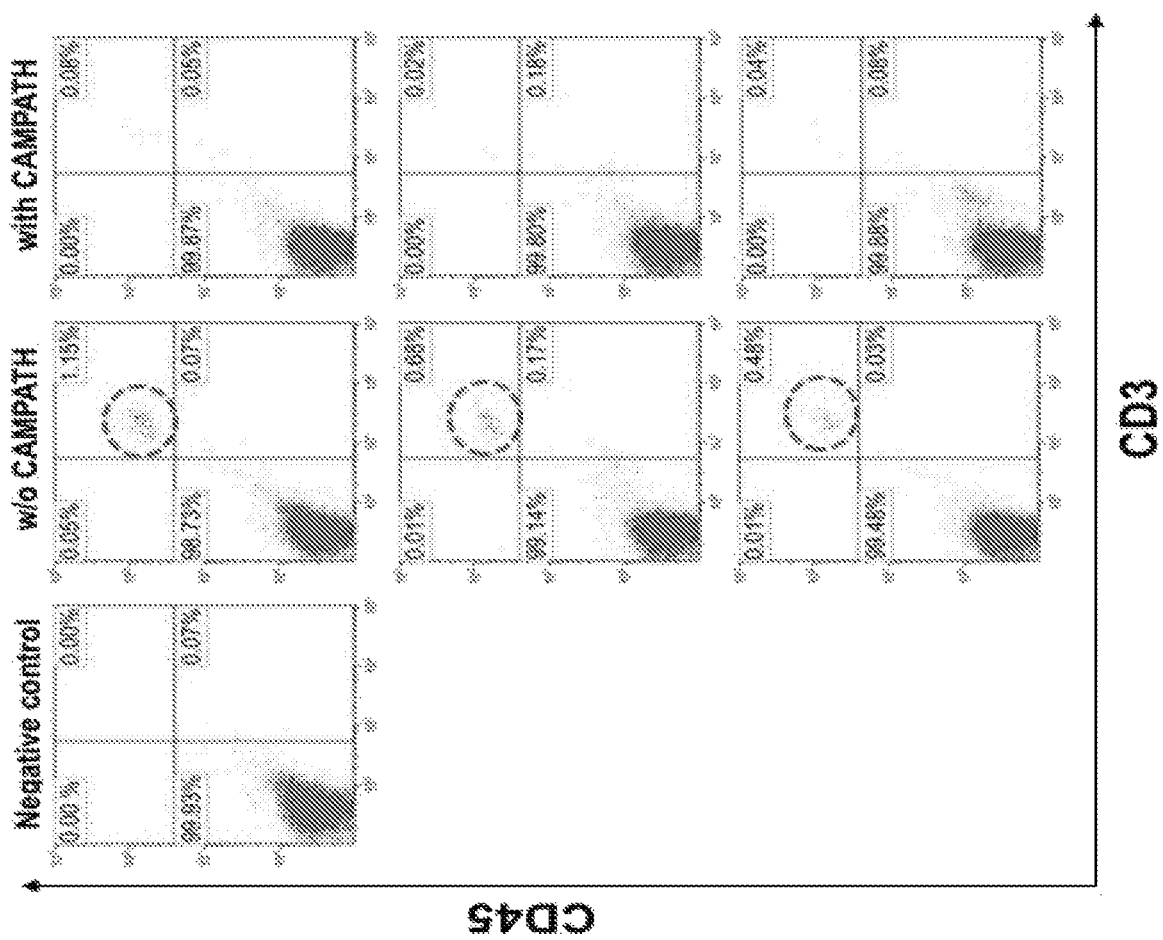
Figure 101C:
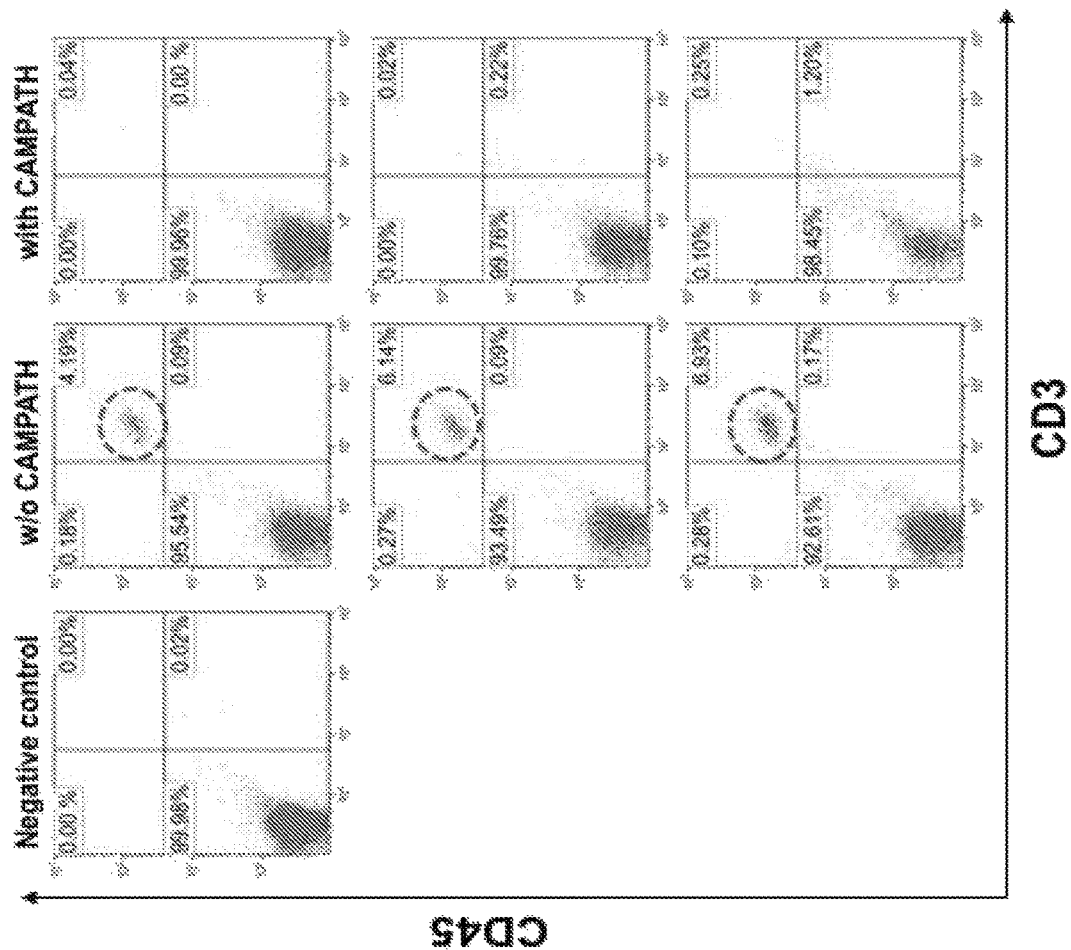

FIGS. 101A-101C. Depletion of CD4CAR T Cells with and without CAMPATH treatment. Experimental design (101A) and determine depletion of peripheral blood engineered CD4CAR T cells in blood (101B and 101C). CD4CAR-T cells (10×10$^6$ cells) were injected intravenously into each NSG mouse (total 6 mouse) after sublethally irradiated. On the following day, PBS or 0.1 mg/kg of CAMPATH was injected via I.P. (intraperitoneal injection) into 3 each mince (N=3). 6 h and 24 h later, peripheral blood was collected from each mouse and labeled using CD3 and CD45 antibodies to determine the depletion of CD4CAR T cells as acute phase response by CAMPATH treatment.

Figure 102:
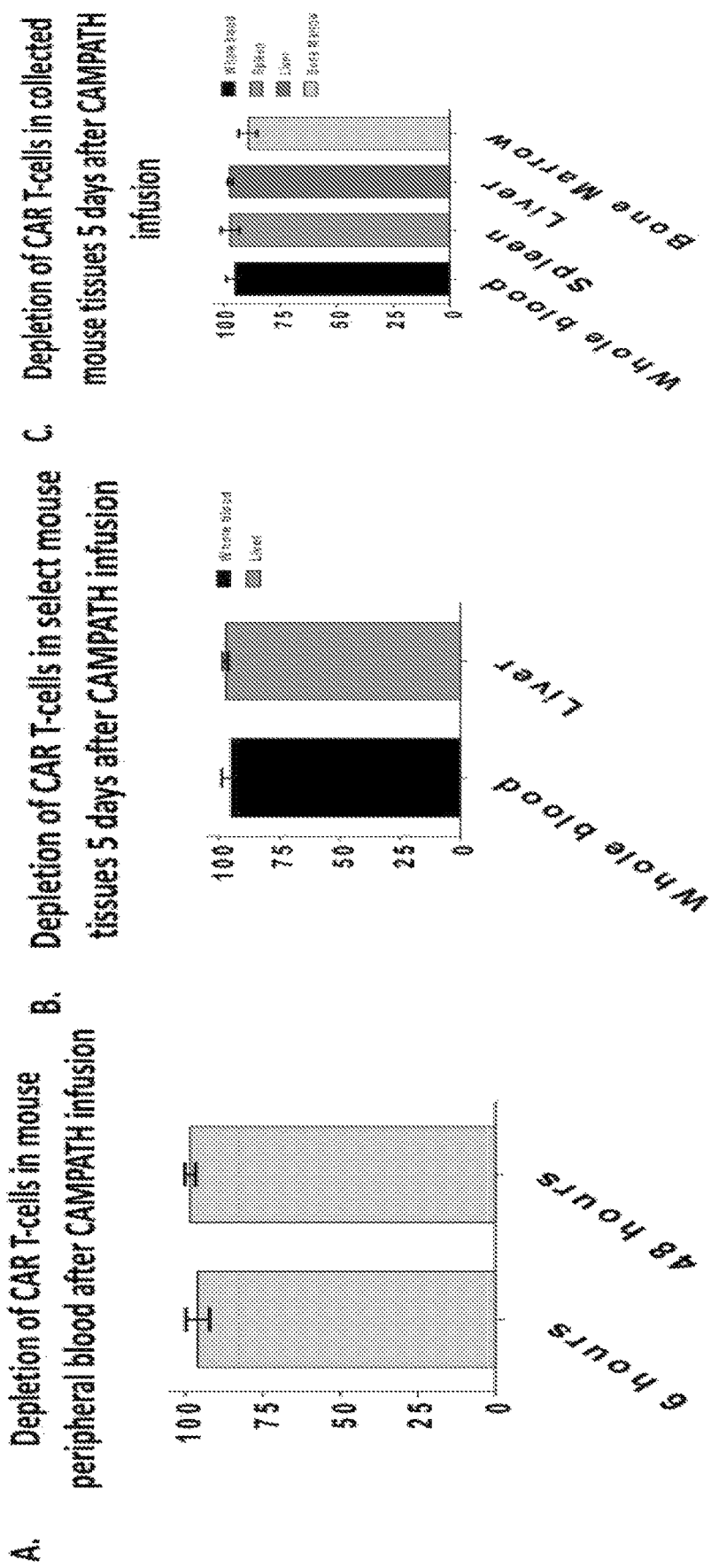

FIG. 102. Summary of effects of CAMPATH treatment on "safety switch" engineered CD4CAR T cells. A, Depletion of CD4CAR T-cells in peripheral blood 6h and 48h after CAMPATH injection; B, Depletion of CD4CAR T-cells in mouse whole blood and liver 5 days after CAMPATH infusion; C, Analysis of engineered CAR T-cell depletion in various tissues.

Figure 104:
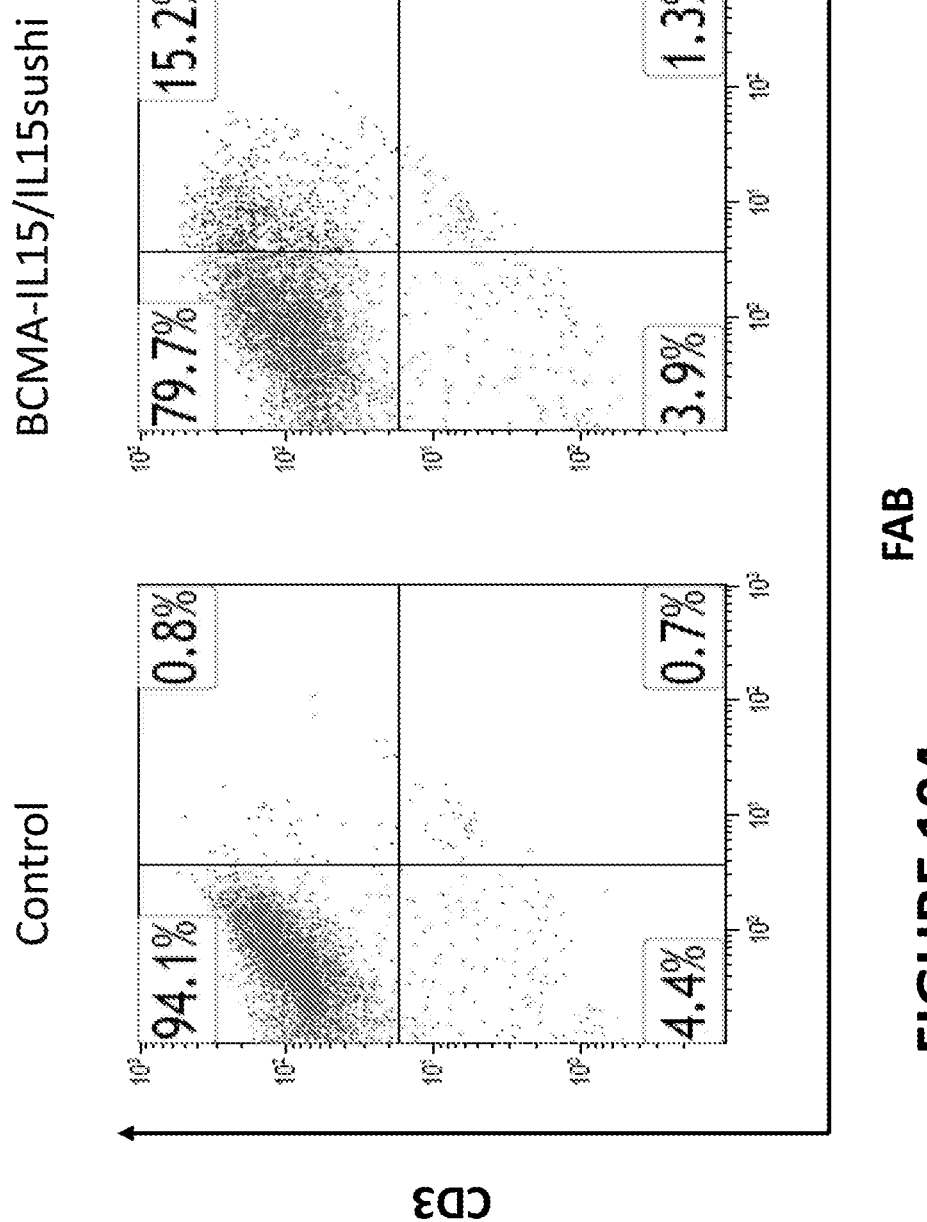

FIG. 104—Expression of BCMA-IL15/IL15sushi CAR T-cells. T-cells isolated from peripheral blood (PB) were transduced with lentivirus expressing either vector control or BCMA-IL15/IL15sushi constructs. Flow cytometry using CD3 and F(ab)' antibodies was done to assay the percentage transduction of the CAR and transduced populations are colored blue. N=2.

Figure 105A:
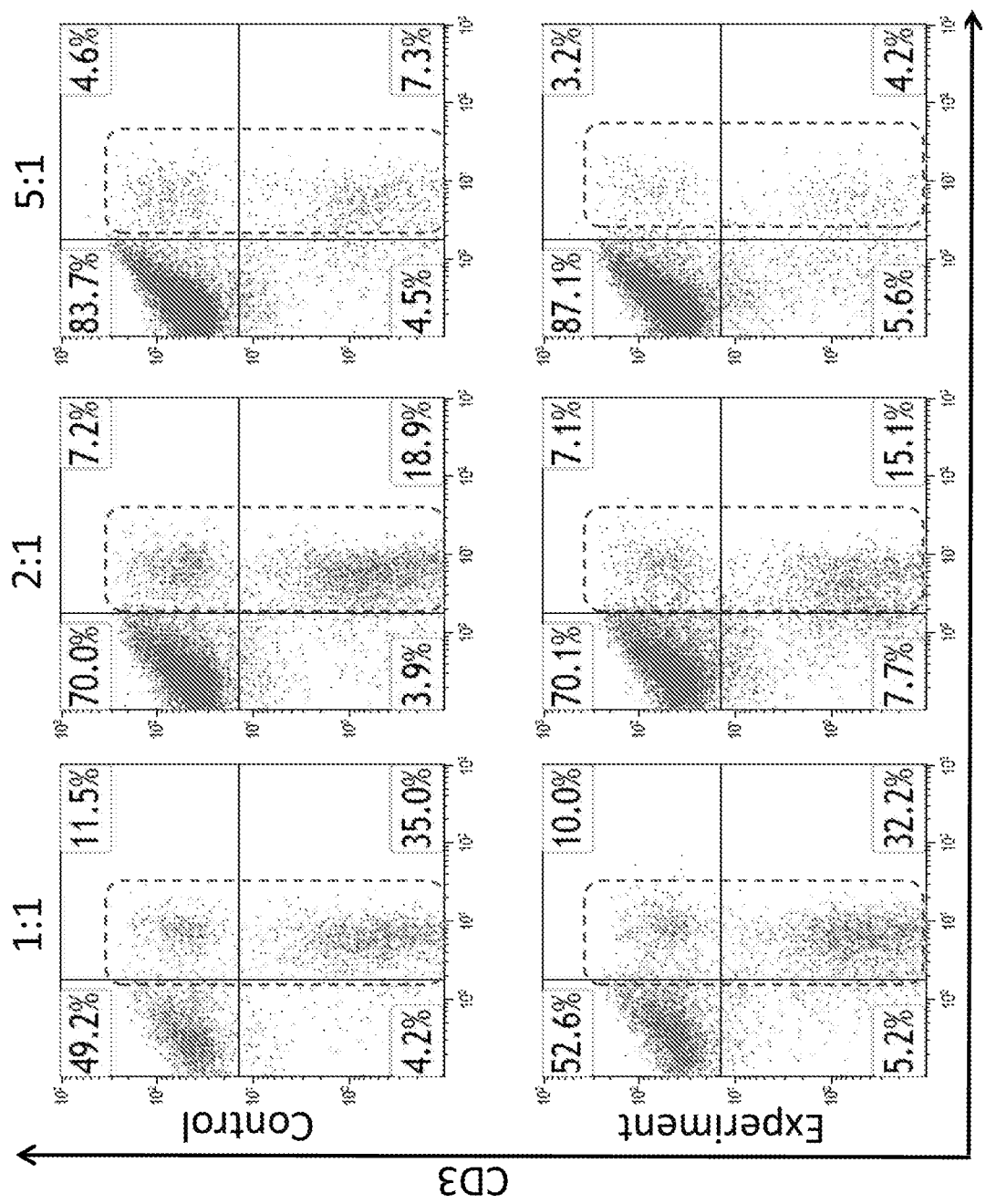

FIG. 105A. BCMA-IL15/IL15sushi CAR T-cells show evidence of a low level of anti-tumor activities against CD19+ cells. BCMA-IL15/IL15sushi targets some CD19+ SP53 cells.

Co-culture experiments were performed at an effector to target ratio of spanning from 1:1 to 5:1 for 24 hours and were directly analyzed by flow cytometry with mouse anti-human CD3pPerCp and mouse anti-human CD19-PE. Each assay includes target cells (Sp53 all CD19+) incubated with either vector control or CAR T-cells. N=2.

Figure 105B:
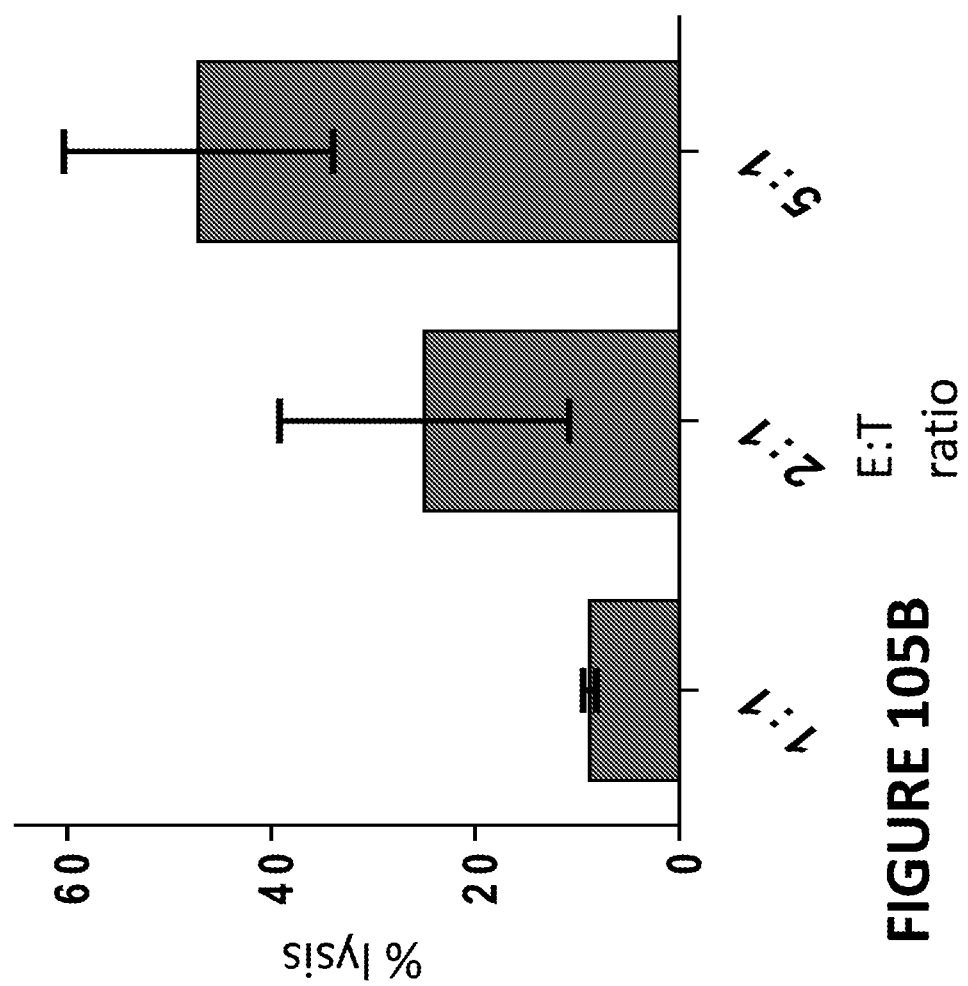

FIG. 105B. Bar graph summarizing cytotoxic activity from results of FIG. 105B.

Figure 106A:
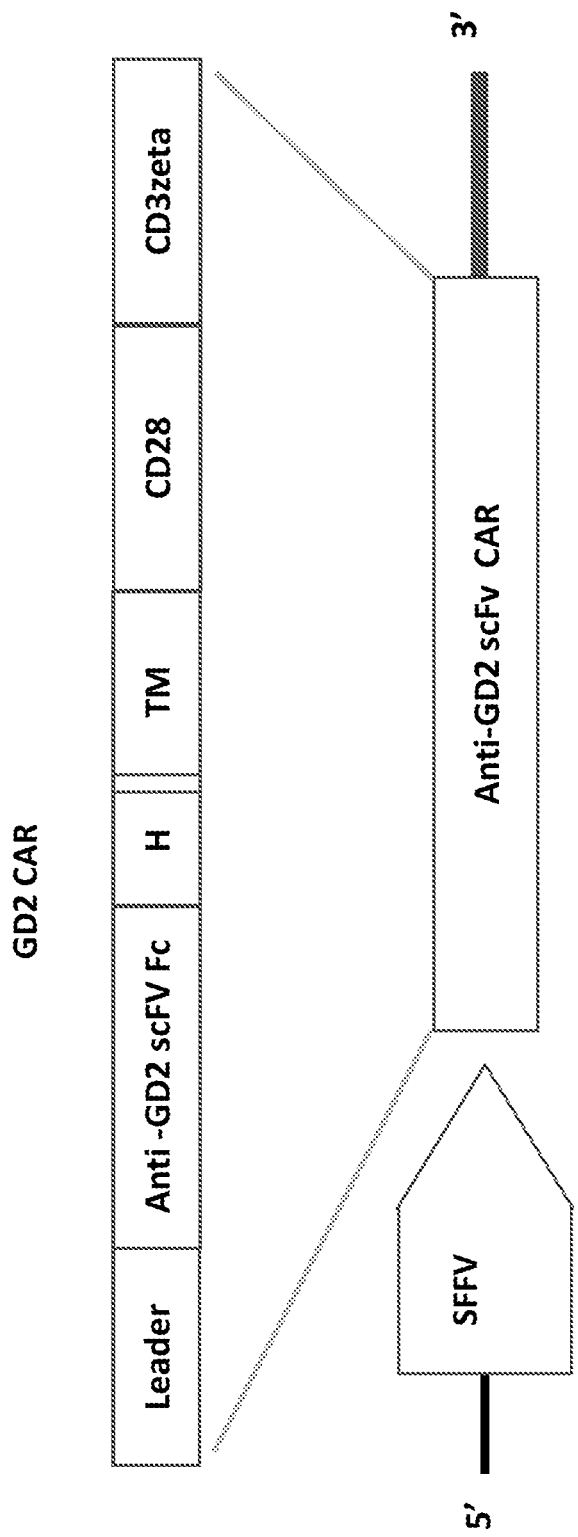

FIG. 106A. Organization of the GD3 CAR construct. The GD2 CAR construct is a modularized signaling domain containing: a leader sequence, a GD2 scFv, a hinge domain (H), a transmembrane domain (TM), a co-stimulatory domains (CD28 or 4-1BB) and the intracellular signaling domain CD3 zeta.

Figure 106B:
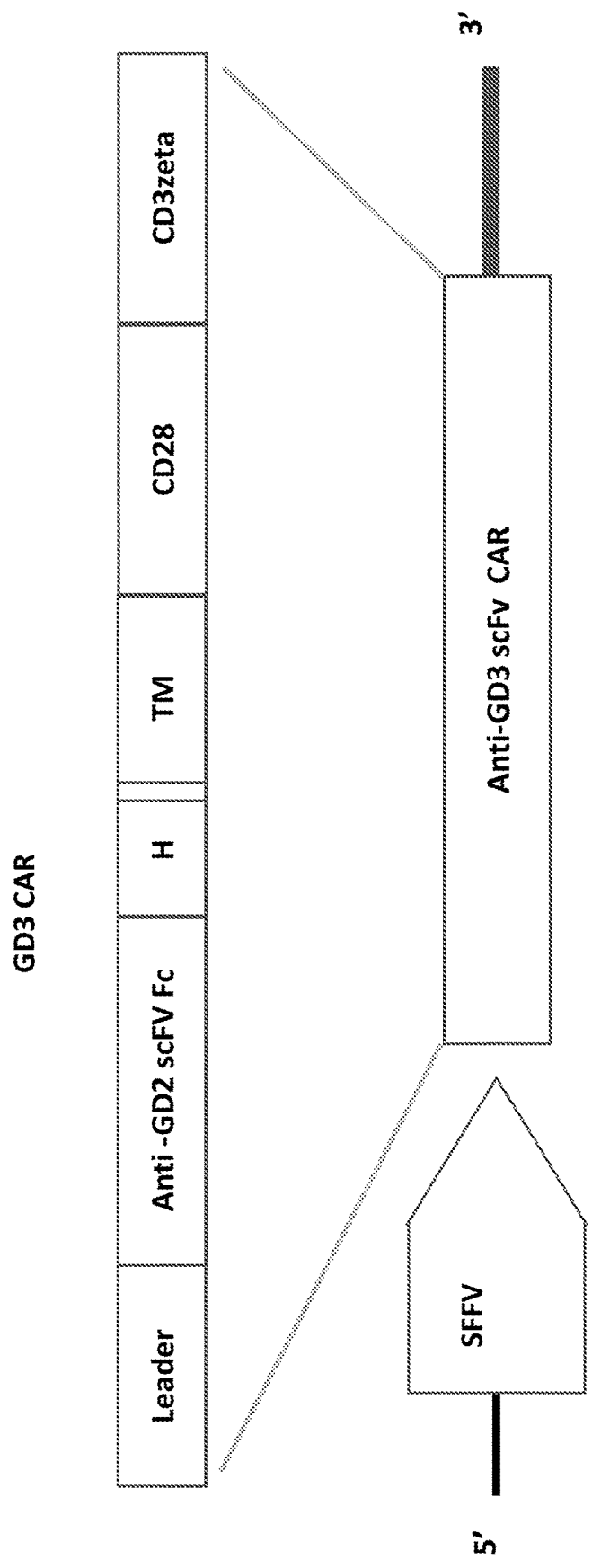

FIG. 106B. Organization of the GD3 CAR construct. The GD3 CAR construct is a modularized signaling domain containing: a leader sequence, a GD3 scFv, a hinge domain (H), a transmembrane domain (TM), a co-stimulatory domains (CD28 or 4-1BB) and the intracellular signaling domain CD3 zeta.

Figure 107A:
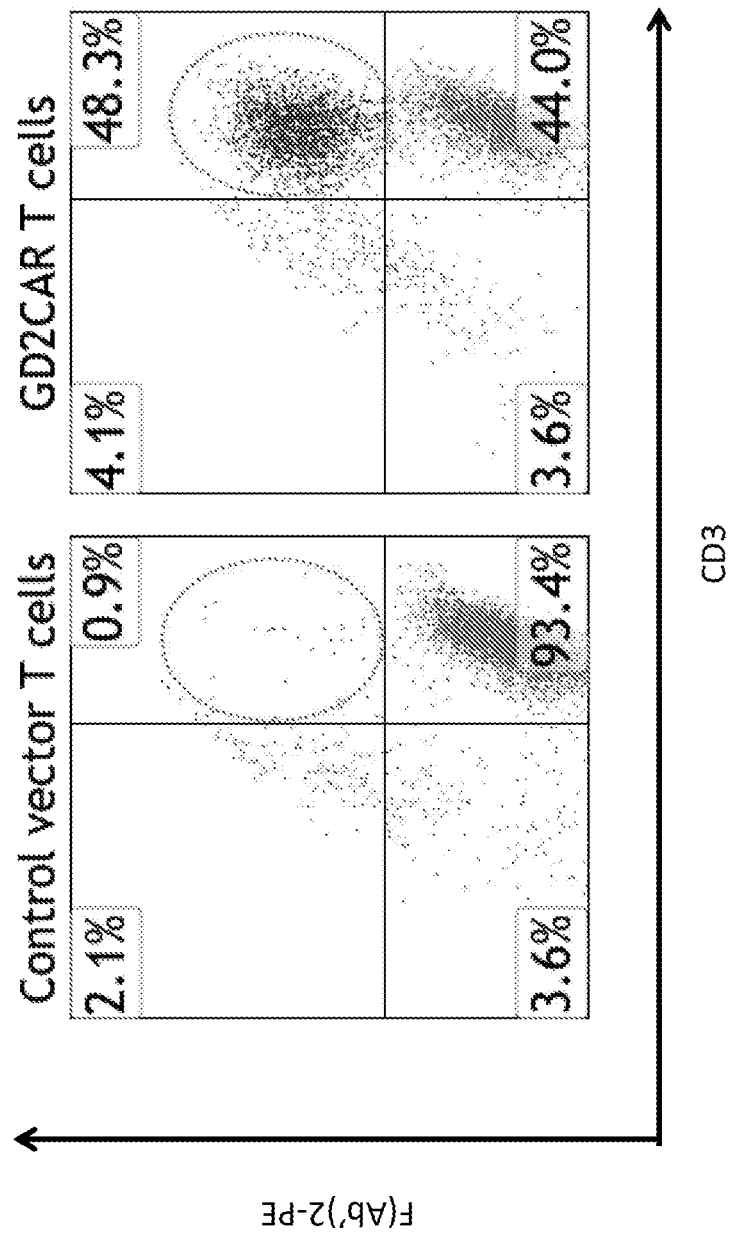

FIG. 107A. GD2 CAR surface expression in human T cells. Activated peripheral blood mononuclear cells were transduced with either vector control (left) or GD2CAR (right) lentiviral vector. Forty-eight hours after recovery, cells were labeled with anti-mouse F(Ab')2-biotin antibody for detection of CAR phenotype.

Figure 107B:
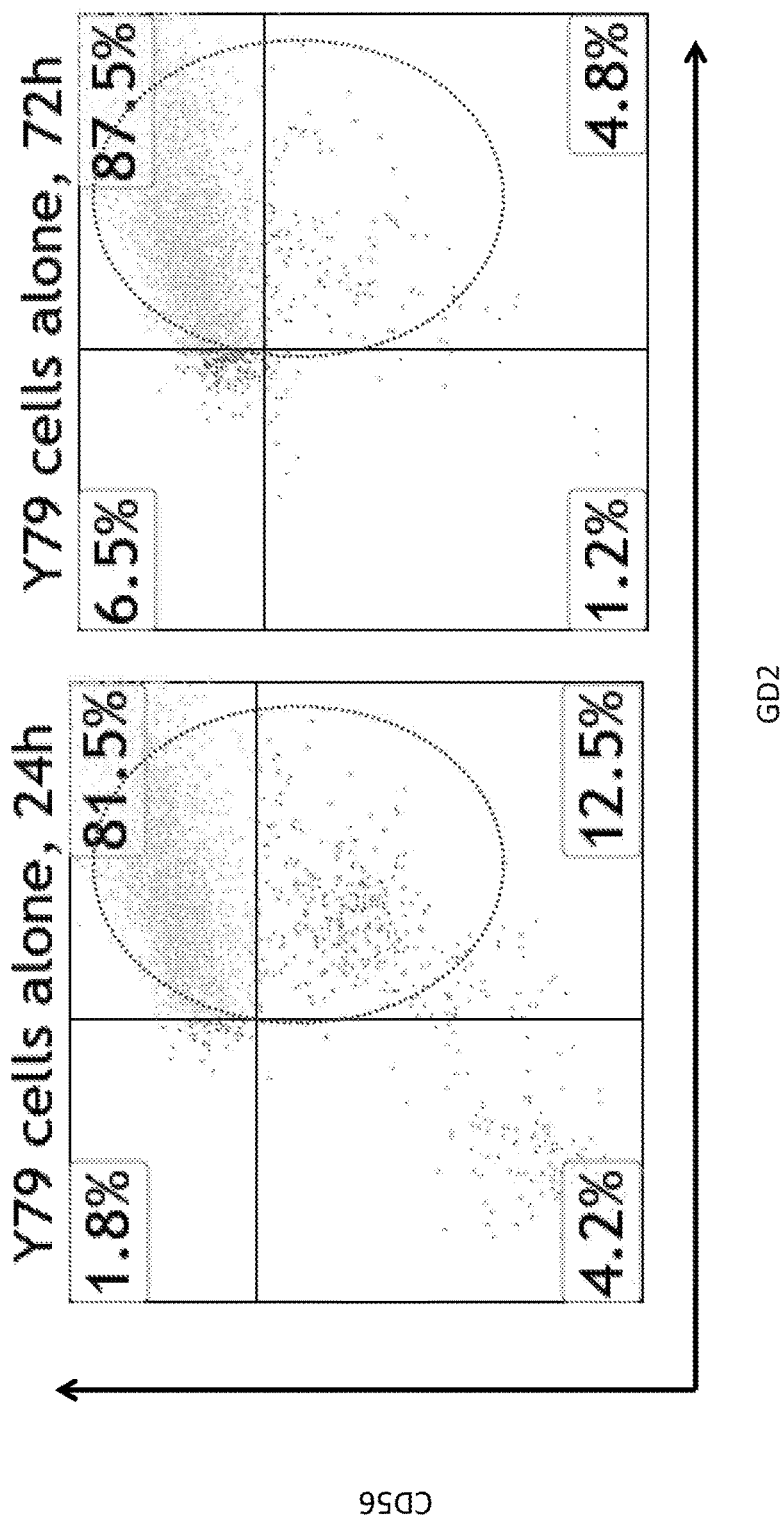

FIG. 107B. Y79 cells alone, labeled with mouse anti-human GD2 and CD56 showing that GD2 expression is seen in almost all retinoblatoma Y79 cells. (N=2).

Figure 107C:
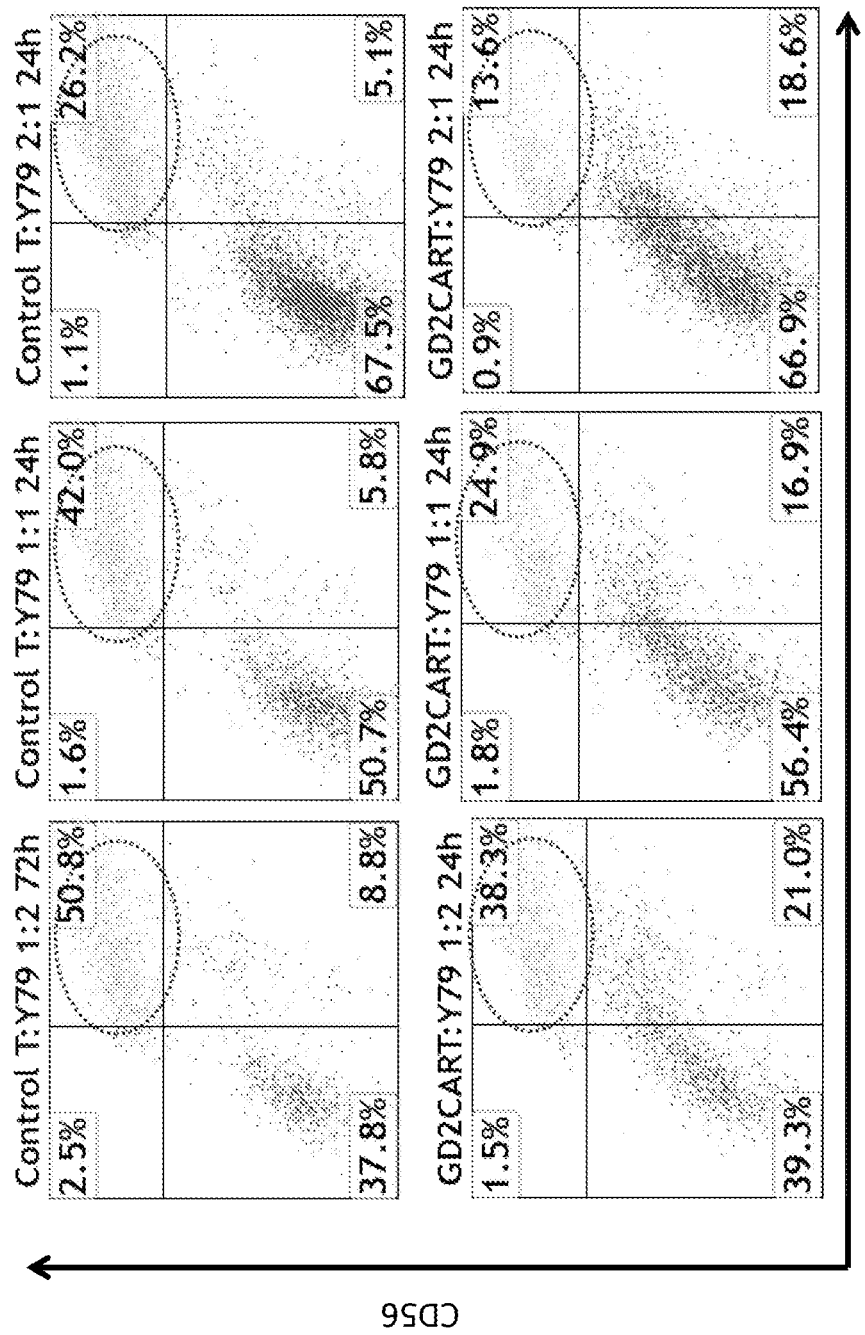

FIG. 107C. Y79 retinoblastoma cells co-cultured with GD2CAR T cells, 24 hours. GD2CAR T cells are able to efficiently lyse the GD2-expressing Y79 retinoblastoma cell line in 24 hour co-culture assays. Co-culture experiments were performed at effector to target ratios ranging from 1:2 to 2:1 for 24 hours and were directly analyzed by flow cytometry for CD56 and GD2. Each assay consists of Y79 target cells vs control T cells (top row), and GD2CAR T cells (bottom row).

Figure 107D:
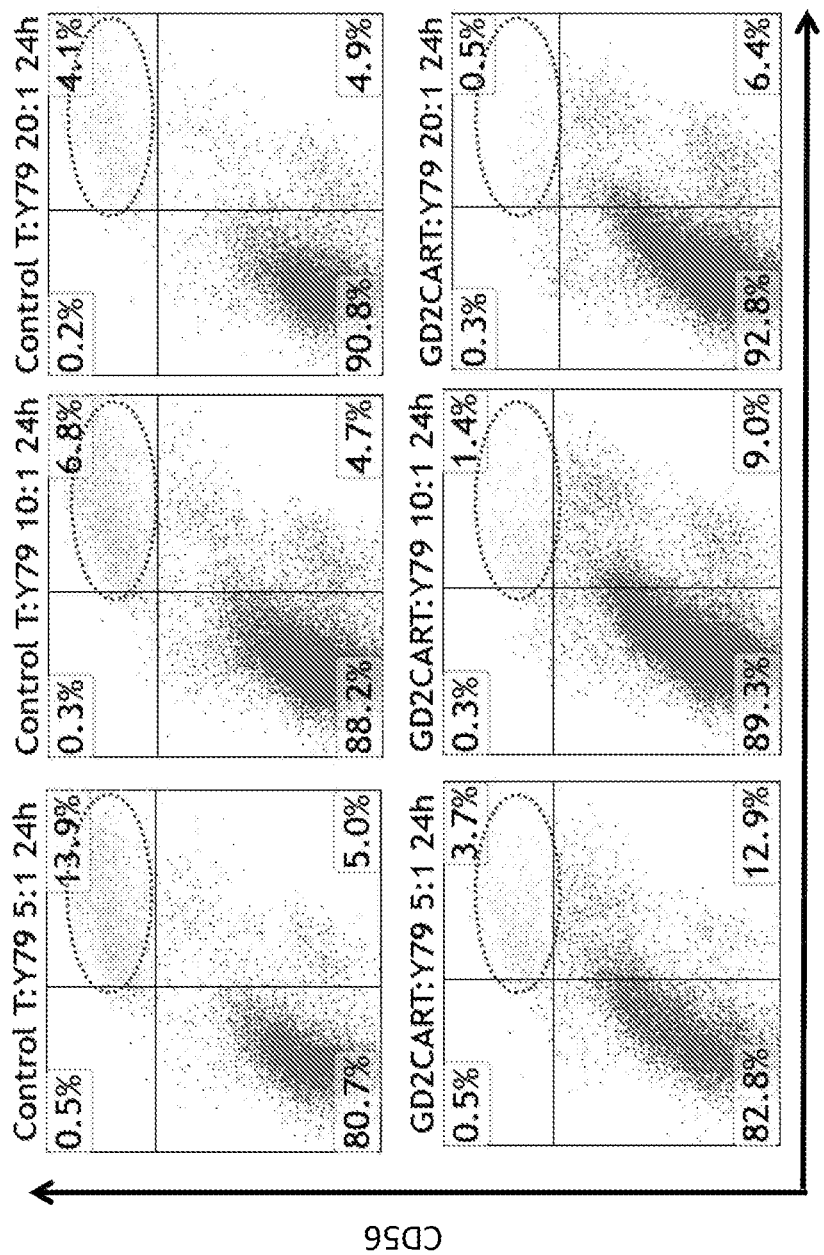

FIG. 107D. Y79 retinoblastoma cells co-cultured with GD2CAR T cells, 24 hours. GD2CAR T cells are able to ablate the GD2-expressing Y79 retinoblastoma cell line in co-culture assays. Co-culture experiments were performed at effector to target ratios ranging from 5:1 to 20:1 for 24 hours and were directly analyzed by flow cytometry for CD56 and GD2. Each assay consists of Y79 target cells vs control T cells (top row), and GD2CAR T cells (bottom row). All are N=2.

Figure 107E:
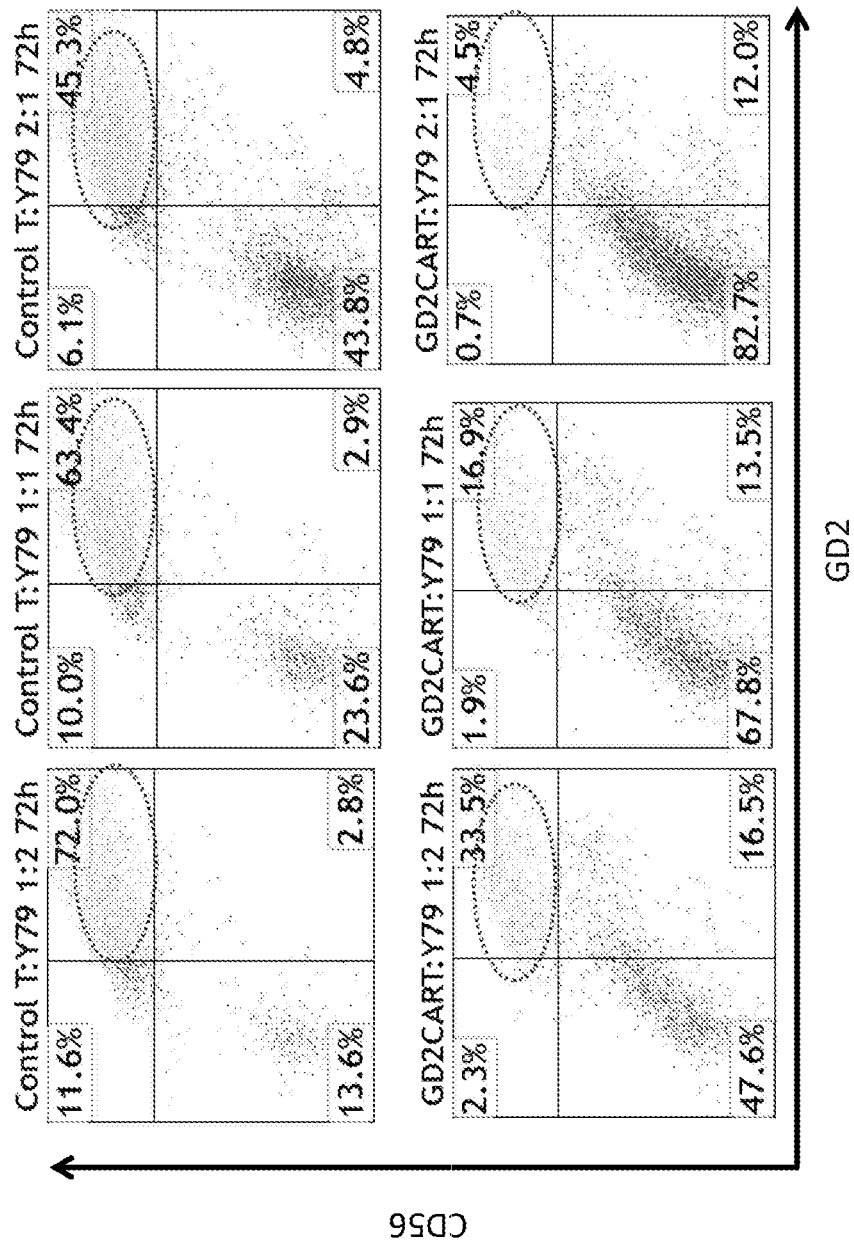

FIG. 107E. Y79 retinoblastoma cells co-cultured with GD2CAR T cells, 72 hours. GD2CAR T cells are able to ablate the GD2-expressing Y79 retinoblastoma cell line in 72 hour co-culture assays. Co-culture experiments were performed at effector to target ratios ranging from 1:2 to 2:1 for 72 hours and were directly analyzed by flow cytometry for CD56 and GD2. Each assay consists of Y79 target cells vs control T cells (top row), and GD2CAR T cells (bottom row).

Figure 107F:
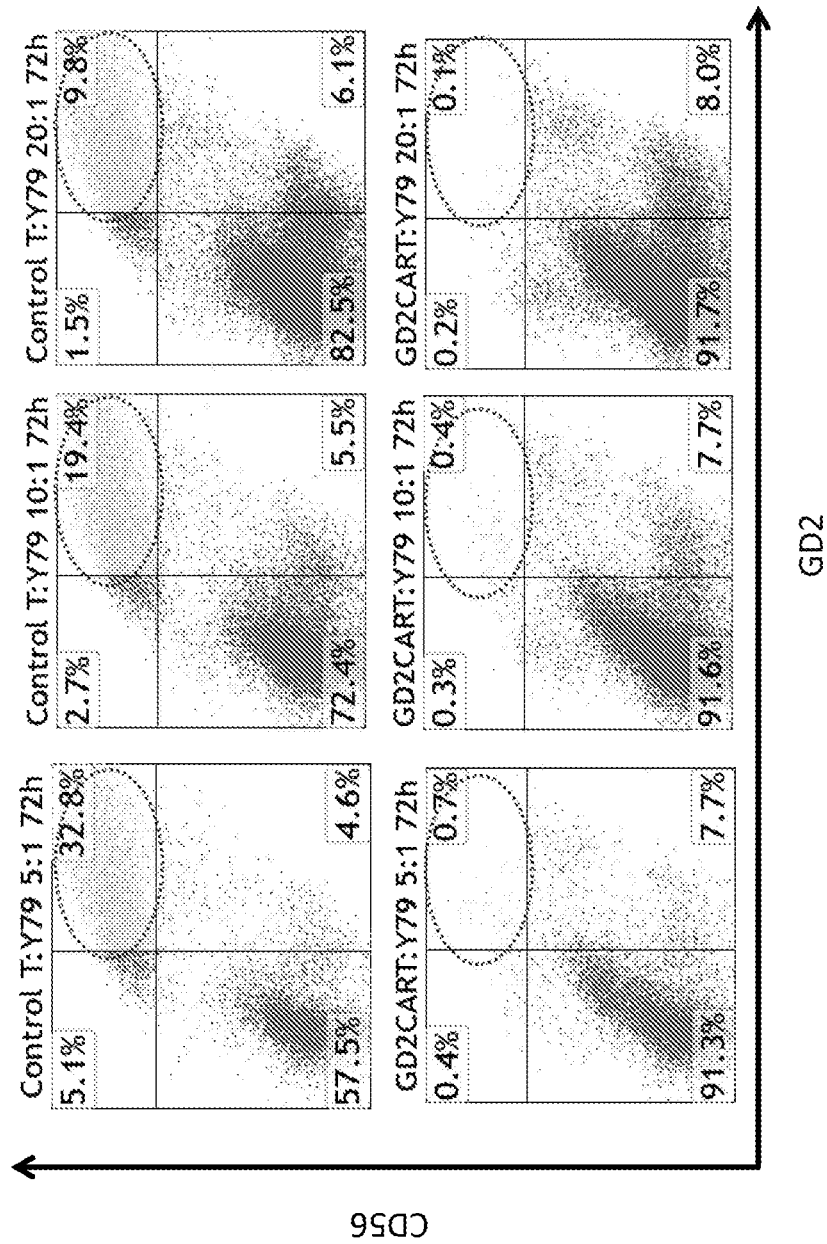

FIG. 107F. GD2CAR T cells are able to ablate the GD2-expressing Y79 retinoblatoma cell line in co-culture assays. Co-culture experiments were performed at effector to target ratios ranging from 5:1 to 20:1 for 72 hours and were directly analyzed by flow cytometry for CD56 and GD2. Each assay consists of Y79 target cells vs control T cells (top row), and GD2CAR T cells (bottom row). All are N=2.

Figure 107G:
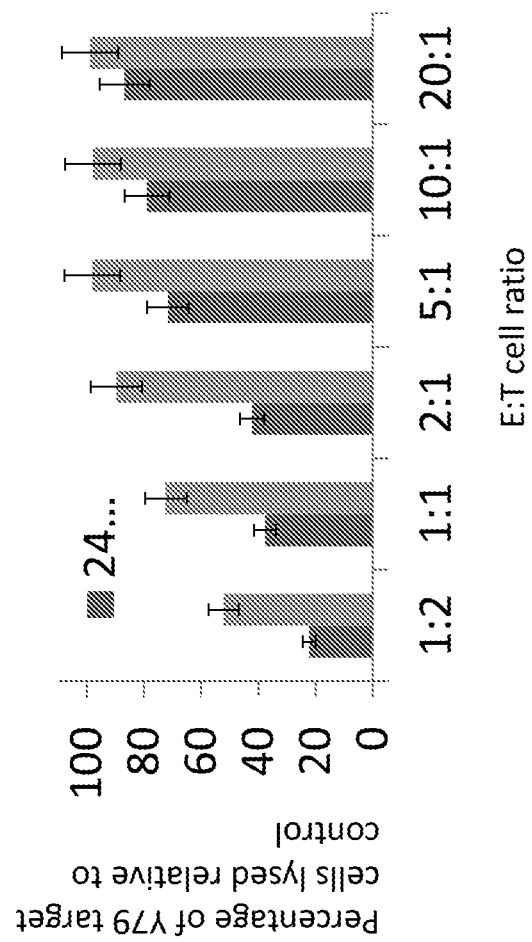

FIG. 107G. Summary of percent Y79 tumor cells lysed by GD2CAR T cells at ratios from 1:2 to 20:1, after 24 and 72 hours co-culture. (N=2) FIG. 108A. Transduction and sorting of GD2CAR NK-92 cells. (A) NK-92 cells were transduced with either control (left) or GD2CAR (right) lentiviral supernatant. After recovery, cells were labelled with goat anti-mouse F(Ab')2 antibody for detection of CAR phenotype. (B) GD2CAR+ NK cells were sorted on FACS Aria. After 10 days recovery and expansion, vector control (left) or sorted GD2CAR (right) NK cells were labeled with anti-mouse F(Ab')2-antibody for detection of CAR phenotype.

Figure 108A:
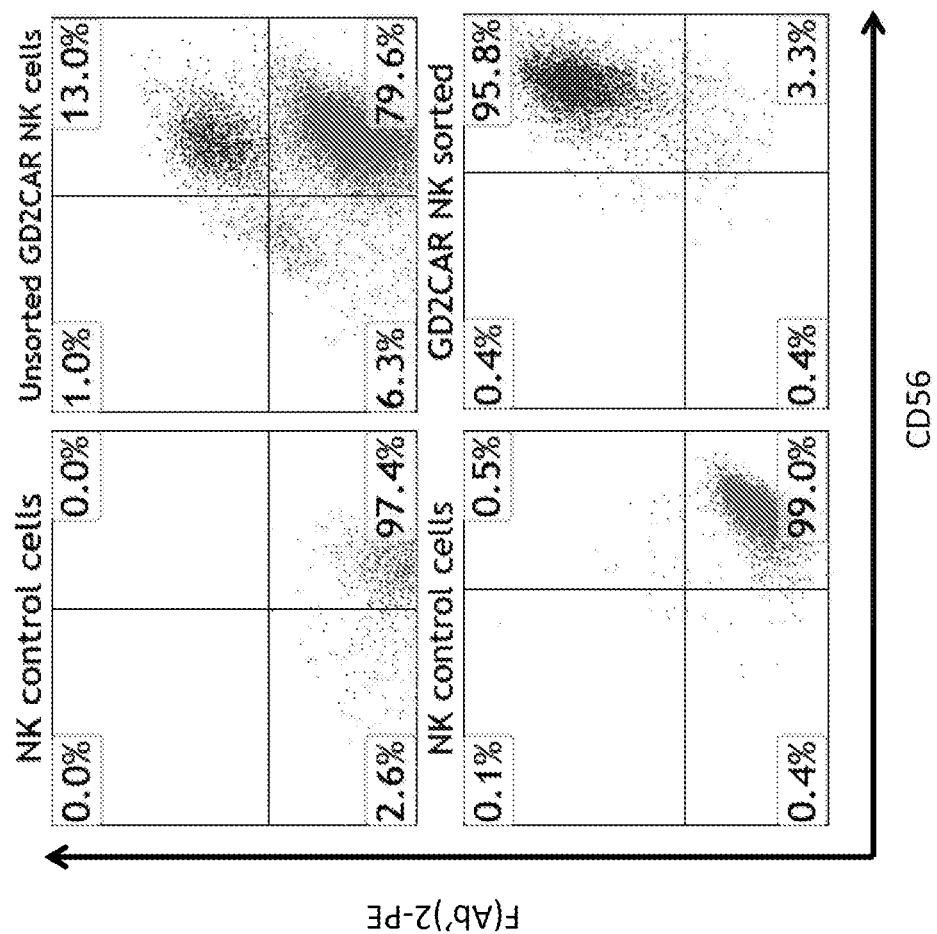
Figure 108B:
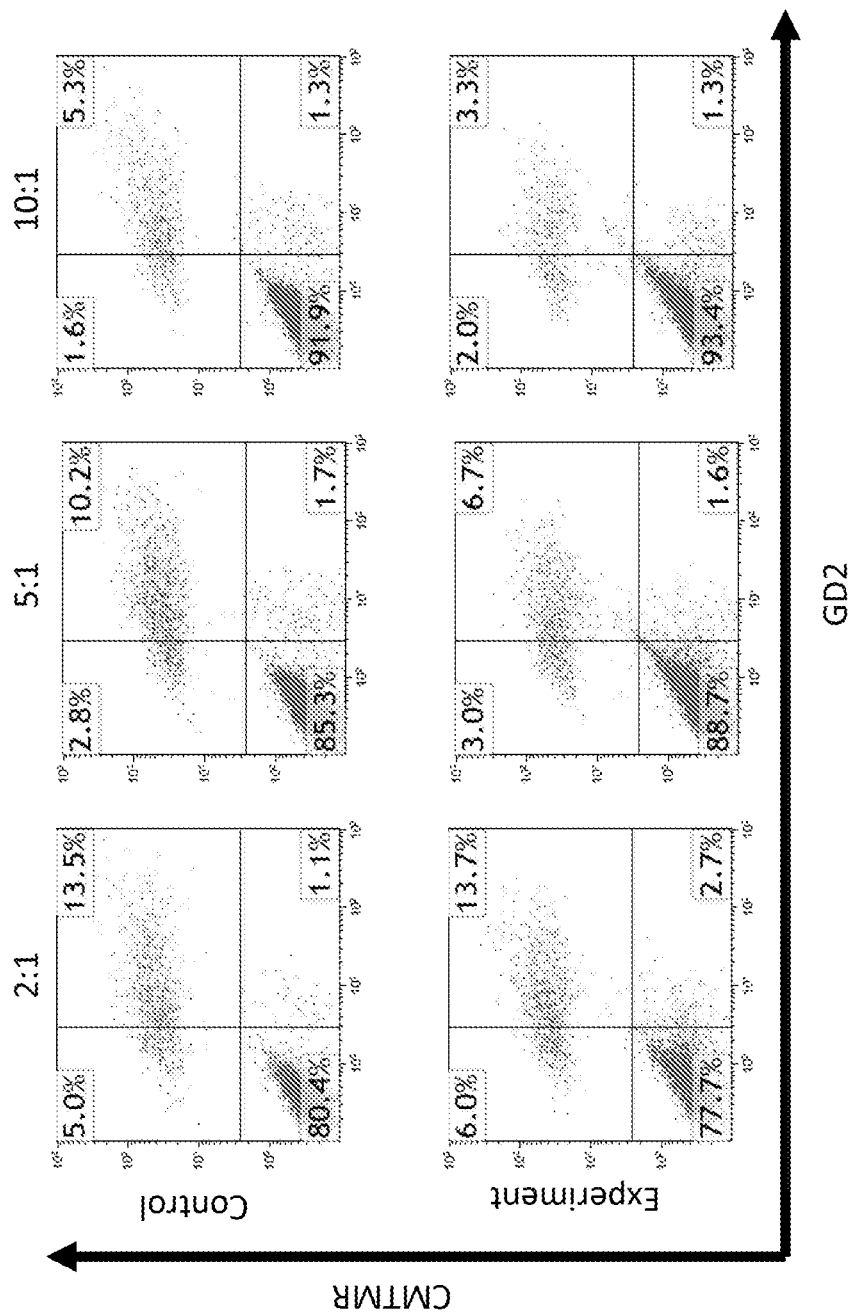

FIG. 108B. Anti-GD2 CAR NK-92 cell against Y79 neuroblastoma cell line. GD2 CAR NK-92 cells exhibit anti-tumor activity against GD2+ neuroblastoma cell line Y79. Y79 neuroblastoma cells were prelabeled with cytotracker (CMTMR) dye and cultured for 24 hours with control NK-92 or anti-GD2 CAR NK-92 cells at varying E:T ratios. GD2 positive Y79 cell populations are colored purple and exhibit the dual CMTMR+GD2+ phenotype. Percent lysis is summarized in bar graph (right).

Figure 108C:
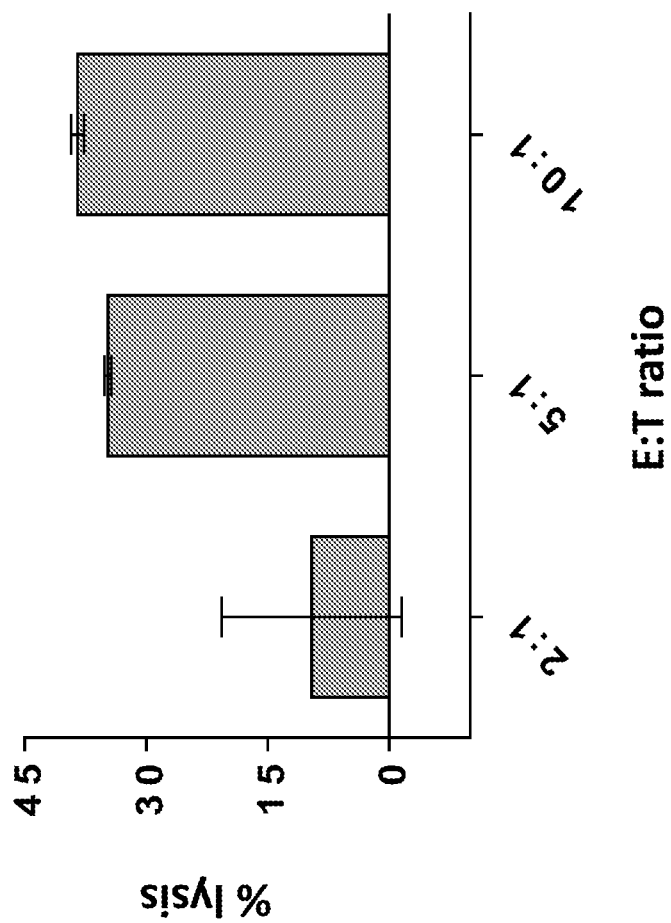

FIG. 108C. Increasing dosage correlates with greater cytotoxicity. Summary of percent Y79 tumor cells lysed by GD2CAR NK-92 cells at ratios from 2:1 to 10:1 showing that increasing dosage correlates with greater cytotoxicity.

Figure 109:
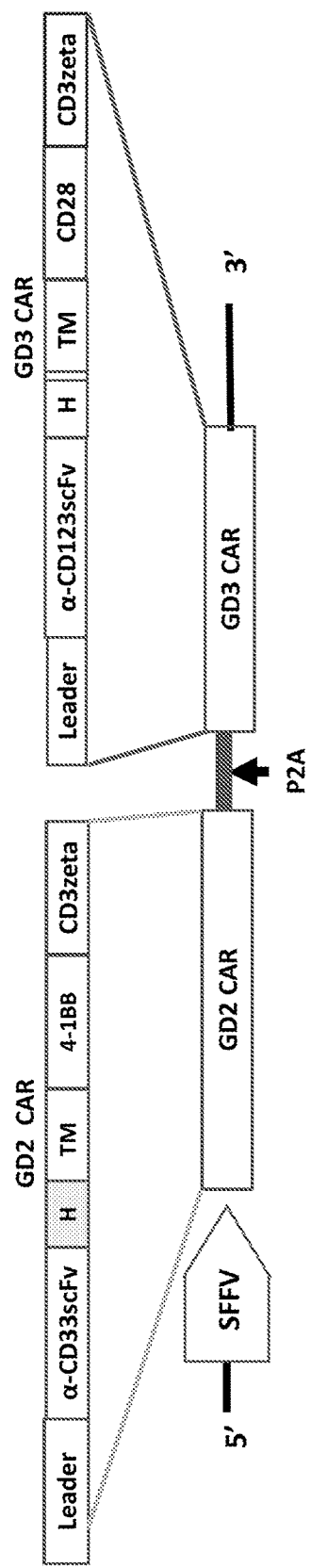

FIG. 109. A schematic representation of GD2-GD3 cCAR construct. The construct comprises a SFFV promoter driving the expression of multiple modular units of CARs linked by a P2A cleavage peptide. Upon cleavage of the P2A linker, the cCARs split and engage upon targets expressing GD2 and/or GD3. Each unit of CAR bears a scFv against the antigen, a hinge domain (H), a transmembrane domain (TM), a co-stimulatory domain (including, but not limited to, CD28 or 4-1BB) and the intracellular signaling domain CD3 zeta chain. As a novel cCAR construct, the activation domains of the construct may include, but is not limited to, 4-1BB on the GD2 CAR segment and a CD28 region on the GD3 CAR.

DETAILED DESCRIPTION

The disclosure provides chimeric antigen receptor (CAR) compositions, methods of making and using thereof.

A chimeric antigen receptor (CAR) polypeptide includes a signal peptide, an antigen recognition domain, a hinge region, a transmembrane domain, at least one co-stimulatory domain, and a signaling domain.

First-generation CARs include CD3z as an intracellular signaling domain, whereas second-generation CARs include at least one single co-stimulatory domain derived from various proteins. Examples of co-stimulatory domains include, but are not limited to, CD28, CD2, 4-1BB (CD137, also referred to as "4-BB"), and OX-40 (CD124). Third generation CARs include two co-stimulatory domains, such as, but not limited to, CD28, 4-1BB, CD134 (OX-40), CD2, and/or CD137 (4-1BB).

As used herein, the terms "peptide," "polypeptide," and "protein" are used interchangeably, and refer to a compound having amino acid residues covalently linked by peptide bonds. A protein or peptide must contain at least two amino acids, and no limitation is placed on the maximum number of amino acids that can be included in a protein's or peptide's sequence. Polypeptides include any peptide or protein having two or more amino acids joined to each other by peptide bonds. As used herein, the term refers to both short chains, which also commonly are referred to in the art as peptides, oligopeptides, and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, and fusion proteins, among others. The polypeptides include natural peptides, recombinant peptides, synthetic peptides, or a combination thereof.

A "signal peptide" includes a peptide sequence that directs the transport and localization of the peptide and any attached polypeptide within a cell, e.g. to a certain cell organelle (such as the endoplasmic reticulum) and/or the cell surface. As used herein, "signal peptide" and "leader sequence" are used interchangeably.

The signal peptide is a peptide of any secreted or transmembrane protein that directs the transport of the polypeptide of the disclosure to the cell membrane and cell surface, and provides correct localization of the polypeptide of the present disclosure. In particular, the signal peptide of the present disclosure directs the polypeptide of the present disclosure to the cellular membrane, wherein the extracellular portion of the polypeptide is displayed on the cell surface, the transmembrane portion spans the plasma membrane, and the active domain is in the cytoplasmic portion, or interior of the cell.

In one embodiment, the signal peptide is cleaved after passage through the endoplasmic reticulum (ER), i.e. is a cleavable signal peptide. In an embodiment, the signal peptide is human protein of type I, II, III, or IV. In an embodiment, the signal peptide includes an immunoglobulin heavy chain signal peptide.

In one embodiment, the signal peptide includes the signal peptide from human CD45. (UniProtKB/Swiss-Prot Accession Number P08575). The CD45 signal peptide is 23 amino acids in length (MYLWLKLLAFGFAFLDTEVFVTG). In some embodiments, the signal peptide may be a functional fragment of the CD45 signal peptide. A functional fragment includes a fragment of at least 10 amino acids of the CD45 signal peptide that directs the appended polypeptide to the cell membrane and cell surface. Examples of fragments of the human CD45 signal peptide include: MYLWLKLLAFG, FAFLDTEVFVTG, and LKLLAFGFAFLDTE.

Functional equivalents of the human CD45 signal peptide have also been contemplated. As used herein, "functional equivalents" are to be understood as mutants that exhibit, in at least one of the abovementioned sequence positions, an amino acid substitution other than the one mentioned specifically, but still lead to a mutant which show the same or similar properties with respect to the wild-type CD45 signal peptide. Functional equivalents include polypeptides having at least 80%, at least 85%, at least 90%, or at least 95% identity to the human CD45 signal peptide, functional fragments thereof, or functional equivalents thereof.

Functional equivalents also include CD45 signal peptides from homologous proteins from other species. Examples of these signal peptides include signal peptide from mouse CD45 (MGLWLKLLAFGFALLDTEVFVTG); signal peptide from rat CD45 (MYLWLKLLAFSLALLGPEVFVTG); signal peptide from sheep CD45 (MTMYLWLKLLAFGFAFLDTAVSVAG); signal peptide from chimpanzee CD45 (MYLWLKLLAFGFAFLDTEVFVTG); and signal peptide from monkey CD45 (MTMYLWLKLLAFGFAFLDTEVFVAG).

In another embodiment, the signal peptide includes the following sequence: MX$^1$LWLKLLAF X$^2$X$^3$AX$^4$LX$^5$X$^6$X$^7$VX$^8$ VX$^9$G; wherein X$^1$, X$^2$, X$^3$, X4, X$^5$, X$^6$, X$^7$, X$^8$, and X9 are independently Y, G, S, F, L, D, P, T, E, or A. In one embodiment, X$^1$ is Y or G; X$^2$ is G or S; X$^3$ and X$^4$ are independently F or L; X$^5$ is D or G; X$^6$ is P or T; X$^7$ is E or A; X$^8$ is F or S; and X$^9$ is A or T.

In one embodiment, the signal peptide includes the signal peptide from human CD8a (MALPVTALLLPLALLL-HAARP). In some embodiments, the signal peptide may be a functional fragment of the CD8a signal peptide. A functional fragment includes a fragment of at least 10 amino acids of the CD8a signal peptide that directs the appended polypeptide to the cell membrane and cell surface. Examples of fragments of the human CD8a signal peptide include: MALPVTALLLPLALLLHAA, MALPVTALLLP, PVTALLLPLALL, and LLLPLALLLHAARP.

In another embodiment, the signal peptide includes the signal peptide from human CD8b (MRPRLWLL-LAAQLTVLHGNSV). In some embodiments, the signal peptide may be a functional fragment of the CD8b signal peptide. A functional fragment includes a fragment of at least 10 amino acids of the CD8b signal peptide that directs the appended polypeptide to the cell membrane and cell surface. Examples of fragments of the human CD8b signal peptide include: MRPRLWLLLAAQ, RLWLL-LAAQLTVLHG, and LWLLLAAQLTVLHGNSV.

Functional equivalents of the human CD8a or CD8b signal peptide have also been contemplated. As used herein, "functional equivalents" are to be understood as mutants which exhibit, in at least one of the abovementioned sequence positions, an amino acid substitution other than the one mentioned specifically, but still lead to a mutant which show the same or similar properties with respect to the wild-type CD8a or CD8b signal peptide. Functional equivalents include polypeptides having at least 80%, at least 85%, at least 90%, or at least 95% identity to the human CD8 signal peptide, functional fragments thereof, or functional equivalents thereof.

Functional equivalents also include CD8a and CD8b signal peptides from homologous proteins from other species.

In one embodiment, the signal peptide includes the signal peptide from human IL-2. The IL-2 signal peptide is 23 amino acids in length (MYRMQLLSCIALSLALVTNS). In some embodiments, the signal peptide may be a functional fragment of the IL-2 signal peptide. A functional fragment includes a fragment of at least 10 amino acids of the IL-2 signal peptide that directs the appended polypeptide to the cell membrane and cell surface. Examples of fragments of the human IL-2 signal peptide include: MYRMQLLSCIAL, QLLSCIALSLAL, and SCIALSLALVTNS.

Functional equivalents of the human IL-2 signal peptide have also been contemplated. As used herein, "functional equivalents" are to be understood as mutants which exhibit, in at least one of the abovementioned sequence positions, an amino acid substitution other than the one mentioned specifically, but still lead to a mutant which show the same or similar properties with respect to the wild-type IL-2 signal peptide. Functional equivalents include polypeptides having at least 80%, at least 85%, at least 90%, or at least 95% identity to the human IL-2 signal peptide, functional fragments thereof, or functional equivalents thereof.

Functional equivalents also include IL-2 signal peptides from homologous proteins from other species. See for example FIG. 80.

In another embodiment, the signal peptide includes the following sequence: $MYX^1X^2QLX^3SCX^4XLX^6LX^7LXX^9X^{10}X^{11}$; wherein $X^1$, $X^2$, $X^3$, $X^4$, $X^5$, $X^6$, $X^7$, $X^8$, $X^9$, $X^{10}$ and $X^{11}$ are independently R, K, S, M, I, V, L, A, I, T, N, S, or G. In one embodiment, $X^1$ is R, K, or S; $X^2$ is M, I, or V; $X^3$ is L or A; $X^4$ and $X^5$ are independently I, A, V, or T; $X^6$ is S or T; $X^7$ is A or V; $X^8$, $X^9$, $X^{10}$, and $X^{11}$ are independently V, L, T, A, N, S, or G.

The "antigen recognition domain" includes a polypeptide that is selective for or targets an antigen, receptor, peptide ligand, or protein ligand of the target; or a polypeptide of the target.

The antigen recognition domain may be obtained from any of the wide variety of extracellular domains or secreted proteins associated with ligand binding and/or signal transduction. The antigen recognition domain may include a portion of Ig heavy chain linked with a portion of Ig light chain, constituting a single chain fragment variable (scFv) that binds specifically to a target antigen. The antibody may be monoclonal or polyclonal antibody or may be of any type that binds specifically to the target antigen. In another embodiment, the antigen recognition domain can be a receptor or ligand. In particular embodiments, the target antigen is specific for a specific disease condition and the disease condition may be of any kind as long as it has a cell surface antigen, which may be recognized by at least one of the chimeric receptor construct present in the compound CAR architecture. In a specific embodiment, the chimeric receptor may be for any cancer for which a specific monoclonal or polyclonal antibody exists or is capable of being generated. In particular, cancers such as neuroblastoma, small cell lung cancer, melanoma, ovarian cancer, renal cell carcinoma, colon cancer, Hodgkin's lymphoma, and childhood acute lymphoblastic leukemia have antigens specific for the chimeric receptors.

In some embodiments, antigen recognition domain can be non-antibody protein scaffolds, such as but not limited to, centyrins, non-antibody protein scaffolds that can be engineered to bind a variety of specific targets with high affinity. Centyrins are scaffold proteins based on human consensus tenascin FN3 domain, are usually smaller than scFv molecules CAR molecules.

The target specific antigen recognition domain preferably includes an antigen binding domain derived from an antibody against an antigen of the target, or a peptide binding an antigen of the target, or a peptide or protein binding an antibody that binds an antigen of the target, or a peptide or protein ligand (including but not limited to a growth factor, a cytokine, or a hormone) binding a receptor on the target, or a domain derived from a receptor (including but not limited to a growth factor receptor, a cytokine receptor or a hormone receptor) binding a peptide or protein ligand on the target.

In one embodiment, the antigen recognition domain includes the binding portion or variable region of a monoclonal or polyclonal antibody directed against (selective for) the target.

In another embodiment, the antigen recognition domain includes camelid single domain antibody, or portions thereof. In one embodiment, camelid single-domain antibodies include heavy-chain antibodies found in camelids, or VHH antibody. A VHH antibody of camelid (for example camel, dromedary, llama, and alpaca) refers to a variable fragment of a camelid single-chain antibody (See Nguyen et al, 2001; Muyldermans, 2001), and also includes an isolated VHH antibody of camelid, a recombinant VHH antibody of camelid, or a synthetic VHH antibody of camelid.

In another embodiment, the antigen recognition domain includes the binding variable region of a monoclonal antibody, single chain fragment variable (scFv). The scFv includes one light and heavy of antibody. In a particular embodiment, antigen recognition domain includes two different heavy chain domains (VHH). Each heavy chain domain binds to a different epitope of the same antigen or different antigen. In one embodiment, the antigen recognition domain includes a single heavy chain domain In another embodiment, the antigen recognition domain includes ligands that engage their cognate receptor. By way of example, APRIL is a ligand that binds the TAC1 receptor or the BCMA receptor. In accordance with the present disclosure, the antigen recognition domain includes APRIL, or a fragment thereof. By way of further example, BAFF is a ligand that binds the BAFF-R receptor or the BCMA receptor. In accordance with the present disclosure, the antigen recognition domain includes BAFF, or a fragment thereof. In another embodiment, the antigen recognition domain is humanized.

It is understood that the antigen recognition domain may include some variability within its sequence and still be selective for the targets disclosed herein. Therefore, it is contemplated that the polypeptide of the antigen recognition domain may be at least 95%, at least 90%, at least 80%, or at least 70% identical to the antigen recognition domain polypeptide disclosed herein and still be selective for the targets described herein and be within the scope of the disclosure.

The target includes interleukin 6 receptor, NY-ESO-1, alpha fetoprotein (AFP), glypican-3 (GPC3), BCMA, BAFF-R, TACI, LeY, CD13, CD14, CD15 CD19, CD20, CD22, CD33, CD41, CD61, CD64, CD68, CD117, CD123, CD138, CD267, CD269, CD38, Flt3 receptor, CS1, CD45, ROR1, PSMA, MAGE A3, Glycolipid, glypican 3, F77, GD-2, WT1, CEA, HER-2/neu, MAGE-3, MAGE-4, MAGE-5, MAGE-6, alpha-fetoprotein, CA 19-9, CA 72-4, NY-ESO, FAP, ErbB, c-Met, MART-1, CD30, EGFRvIII, immunoglobin kappa and lambda, CD38, CD52, CD3, CD4, CD8, CD5, CD7, CD2, and CD138.

In another embodiment, the target includes any portion interleukin 6 receptor, NY-ESO-1, alpha fetoprotein (AFP), glypican-3 (GPC3), BCMA, BAFF-R, TACI, LeY, CD13, CD14, CD15 CD19, CD20, CD22, CD33, CD41, CD61, CD64, CD68, CD117, CD123, CD138, CD267, CD269, CD38, Flt3 receptor, CS1, CD45, TACI, ROR1, PSMA, MAGE A3, Glycolipid, glypican 3, F77, GD-2, WT1, CEA, HER-2/neu, MAGE-3, MAGE-4, MAGE-5, MAGE-6, alpha-fetoprotein, CA 19-9, CA 72-4, NY-ESO, FAP, ErbB, c-Met, MART-1, CD30, EGFRvIII, immunoglobin kappa and lambda, CD38, CD52, CD3, CD4, CD8, CD5, CD7, CD2, and CD138.

In one embodiment, the target includes surface exposed portions of interleukin 6 receptor, NY-ESO-1, alpha fetoprotein (AFP), glypican-3 (GPC3), BCMA, BAFF-R, TACI, LeY, CD13, CD14, CD15 CD19, CD20, CD22, CD33, CD41, CD61, CD64, CD68, CD117, CD123, CD138, CD267, CD269, CD38, Flt3 receptor, CS1, CD45, TACI, ROR1, PSMA, MAGE A3, Glycolipid, glypican 3, F77, GD-2, WT1, CEA, HER-2/neu, MAGE-3, MAGE-4, MAGE-5, MAGE-6, alpha-fetoprotein, CA 19-9, CA 72-4, NY-ESO, FAP, ErbB, c-Met, MART-1, CD30, EGFRvIII, immunoglobin kappa and lambda, CD38, CD52, CD3, CD4, CD8, CD5, CD7, CD2, and CD138 polypeptides.

For example, the target includes the surface exposed regions of BAFF, as shown in FIG. 81. The target may include a portion of the surface exposed regions of BAFF. For example, portions of BAFF include residues 1-200, 1-100, 50-150, or 100-200 of human BAFF.

In another embodiment, the target antigens include viral or fungal antigens, such as E6 and E7 from the human papillomavirus (HPV) or EBV (Epstein Barr virus) antigens; portions thereof; or surface exposed regions thereof.

In another embodiment, the target includes FcER1A, FCER1, and Ig E. FCER1 is a high-affinity Ig E receptor, which includes the alpha chain (FcER1A), beta chain, and two gamma chains. The target may be present on a cell surface. Examples of cells include plasma cells, mast cells basophils or eosinophils.

In one embodiment, the target includes the extracellular domain of FcER1A. The target also includes fragments or portions of the FcER1A extracellular domain. For example, the target includes residues 1-178, 1-100, 50-150, or 100-178 of human FcER1A.

In another embodiment, the target includes any extracellular domain of the FCER1 receptor.

In one embodiment, the TACI antigen recognition domain includes SEQ ID NO. 24.

In one embodiment, the BCMA antigen recognition domain includes SEQ ID NO. 25.

In one embodiment, the CS1 antigen recognition domain includes SEQ ID NO. 26.

In one embodiment, the BAFF-R antigen recognition domain includes SEQ ID NO. 27.

In one embodiment, the CD33 antigen recognition domain includes SEQ ID NO. 28.

In one embodiment, the CD123 antigen recognition domain includes SEQ ID NO. 29.

In one embodiment, the CD19 antigen recognition domain includes SEQ ID NO. 30.

In one embodiment, the CD20 antigen recognition domain includes SEQ ID NO. 31. In another embodiment, the CD20 antigen recognition domain includes SEQ ID NO. 32.

In one embodiment, the CD22 antigen recognition domain includes SEQ ID NO. 33.

In on embodiment, the CD45 antigen recognition domain includes SEQ ID NO. 34.

In on embodiment, the CD4 antigen recognition domain includes SEQ ID NO. 35

In on embodiment, the CD25 antigen recognition domain includes SEQ ID NO. 36

The hinge region is a sequence positioned between for example, including, but not limited to, the chimeric antigen receptor, and at least one co-stimulatory domain and a signaling domain. The hinge sequence may be obtained including, for example, from any suitable sequence from any genus, including human or a part thereof. Such hinge regions are known in the art. In one embodiment, the hinge region includes the hinge region of a human protein including CD-8 alpha, CD28, 4-1BB, OX40, CD3-zeta, T cell receptor α or β chain, a CD3 zeta chain, CD28, CD3ε, CD45, CD4, CD5, CD8, CD8a, CD9, CD16, CD22, CD33, CD37, CD64, CD80, CD86, CD134, CD137, ICOS, CD154, functional derivatives thereof, and combinations thereof.

In one embodiment the hinge region includes the CD8 a hinge region.

In some embodiments, the hinge region includes one selected from, but not limited to, immunoglobulin (e.g. IgG1, IgG2, IgG3, IgG4, and IgD).

The transmembrane domain includes a hydrophobic polypeptide that spans the cellular membrane. In particular, the transmembrane domain spans from one side of a cell membrane (extracellular) through to the other side of the cell membrane (intracellular or cytoplasmic).

The transmembrane domain may be in the form of an alpha helix or a beta barrel, or combinations thereof. The transmembrane domain may include a polytopic protein, which has many transmembrane segments, each alpha-helical, beta sheets, or combinations thereof.

In one embodiment, the transmembrane domain that is naturally associated with one of the domains in the CAR is used. In another embodiment, the transmembrane domain is selected or modified by amino acid substitution to avoid binding of such domains to the transmembrane domains of the same or different surface membrane proteins to minimize interactions with other members of the receptor complex.

For example, a transmembrane domain includes a transmembrane domain of a T-cell receptor α or β chain, a CD3 zeta chain, CD28, CD3ε, CD45, CD4, CD5, CD7, CD8, CD9, CD16, CD22, CD33, CD37, CD64, CD80, CD86, CD68, CD134, CD137, ICOS, CD41, CD154, functional derivatives thereof, and combinations thereof.

In one embodiment, the transmembrane domain is artificially designed so that more than 25%, more than 50% or more than 75% of the amino acid residues of the domain are hydrophobic residues such as leucine and valine. In one embodiment, a triplet of phenylalanine, tryptophan and valine is found at each end of the synthetic transmembrane domain.

In one embodiment, the transmembrane domain is the CD8 transmembrane domain. In another embodiment, the transmembrane domain is the CD28 transmembrane domain. Such transmembrane domains are known in the art.

The signaling domain and co-stimulatory domain include polypeptides that provide activation of an immune cell to stimulate or activate at least some aspect of the immune cell signaling pathway.

In an embodiment, the signaling domain includes the polypeptide of a functional signaling domain of CD3 zeta, common FcR gamma (FCER1G), Fc gamma RIIa, FcR beta (Fc Epsilon Rib), CD3 gamma, CD3 delta, CD3 epsilon, CD79a, CD79b, DNAX-activating protein 10 (DAP10), DNAX-activating protein 12 (DAP12), active fragments thereof, functional derivatives thereof, and combinations thereof. Such signaling domains are known in the art.

In an embodiment, the CAR polypeptide further includes one or more co-stimulatory domains. In an embodiment, the co-stimulatory domain is a functional signaling domain from a protein including one or more of the IL-15 receptor alpha; IL-15 receptor alpha cytoplasmic domain; B7-1/CD80; CD28; B7-2/CD86; CTLA-4; B7-H1/PD-L1; ICOS; B7-H2; PD-1; B7-H3; PD-L2; B7-H4; PDCD6; BTLA; 4-1BB/TNFRSF9/CD137; CD40 Ligand/TNFSF5; 4-1BB Ligand/TNFSF9; GITR/TNFRSF18; BAFF/BLyS/TNFSF13B; GITR Ligand/TNFSF18; BAFF R/TNFRSF13C; HVEM/TNFRSF14; CD27/TNFRSF7; LIGHT/TNFSF14; CD27 Ligand/TNFSF7; OX40/TNFRSF4; CD30/TNFRSF8; OX40 Ligand/TNFSF4; CD30 Ligand/TNFSF8; TACI/TNFRSF13B; CD40/TNFRSF5; 2B4/CD244/SLAMF4; CD84/SLAMF5; BLAME/SLAMF8; CD229/SLAMF3; CD2, CD27, CRACC/SLAMF7; CD2F-10/SLAMF9; NTB-A/SLAMF6; CD48/SLAMF2; SLAM/CD150; CD58/LFA-3; Ikaros; CD53; Integrin alpha 4/CD49d; CD82/Kai-1; Integrin alpha 4 beta 1; CD90/Thy1; Integrin alpha 4 beta 7/LPAM-1; CD96; LAG-3; CD160; LMIR1/CD300A; CRTAM; TCL1A; DAP12; TIM-1/KIM-1/HAVCR; Dectin-1/CLEC7A; TIM-4; DPPIV/CD26; TSLP; EphB6; TSLP R; and HLA-DR, OX40; CD30; CD40; PD-1; CD7; CD258; Natural killer Group 2 member C (NKG2C); Natural killer Group 2 member D (NKG2D), B7-H3; a ligand that binds to at least one of CD83, ICAM-1, LFA-1 (CD11a/CD18), ICOS, and 4-1BB (CD137); CDS; ICAM-1; LFA-1 (CD1a/CD18); CD40; CD27; CD7; B7-H3; NKG2C; PD-1; ICOS; active fragments thereof; functional derivatives thereof; and combinations thereof.

As used herein, the at least one co-stimulatory domain and signaling domain may be collectively referred to as the intracellular domain. As used herein, the hinge region and the antigen recognition domain may be collectively referred to as the extracellular domain.

The present disclosure further provides a polynucleotide encoding the chimeric antigen receptor polypeptide described above.

The term "polynucleotide" as used herein is defined as a chain of nucleotides. Polynucleotide includes DNA and RNA. Furthermore, nucleic acids are polymers of nucleotides. Thus, nucleic acids and polynucleotides as used herein are interchangeable. One skilled in the art has the general knowledge that nucleic acids are polynucleotides, which can be hydrolyzed into the monomeric "nucleotides." The monomeric nucleotides can be hydrolyzed into nucleosides. As used herein polynucleotides include, but are not limited to, all nucleic acid sequences which are obtained by any means available in the art, including, without limitation, recombinant means, i.e., the cloning of nucleic acid sequences from a recombinant library or a cell genome, using ordinary cloning technology and polymerase chain reaction (PCR), and the like, and by synthetic means.

The polynucleotide encoding the CAR is easily prepared from an amino acid sequence of the specified CAR by any conventional method. A base sequence encoding an amino acid sequence can be obtained from the aforementioned NCBI RefSeq IDs or accession numbers of GenBenk for an amino acid sequence of each domain, and the nucleic acid of the present disclosure can be prepared using a standard molecular biological and/or chemical procedure. For example, based on the base sequence, a polynucleotide can be synthesized, and the polynucleotide of the present disclosure can be prepared by combining DNA fragments which are obtained from a cDNA library using a polymerase chain reaction (PCR).

In one embodiment, the polynucleotide disclosed herein is part of a gene, or an expression or cloning cassette.

The polynucleotide described above can be cloned into a vector. A "vector" is a composition of matter which includes an isolated polynucleotide and which can be used to deliver the isolated polynucleotide to the interior of a cell. Numerous vectors are known in the art including, but not limited to, linear polynucleotides, polynucleotides associated with ionic or amphiphilic compounds, plasmids, phagemid, cosmid, and viruses. Viruses include phages, phage derivatives. Thus, the term "vector" includes an autonomously replicating plasmid or a virus. The term should also be construed to include non-plasmid and non-viral compounds which facilitate transfer of nucleic acid into cells, such as, for example, polylysine compounds, liposomes, and the like. Examples of viral vectors include, but are not limited to, adenoviral vectors, adeno-associated virus vectors, retroviral vectors, lentiviral vectors, and the like. In one embodiment, vectors include cloning vectors, expression vectors, replication vectors, probe generation vectors, integration vectors, and sequencing vectors.

In an embodiment, the vector is a viral vector. In an embodiment, the viral vector is a retroviral vector or a lentiviral vector. In an embodiment, the engineered cell is virally transduced to express the polynucleotide sequence.

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the patient either in vivo or ex vivo. A number of retroviral systems are known in the art. In some embodiments, adenovirus vectors are used. A number of adenovirus vectors are known in the art. In one embodiment, lentivirus vectors are used.

Viral vector technology is well known in the art and is described, for example, in Sambrook et al, (2001, Molecular Cloning: A Laboratory Manual, Cold Spring Harbor Laboratory, New York), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient and unique restriction endonuclease sites, and one or more selectable markers, (e.g., WO 01/96584; WO 01/29058; and U.S. Pat. No. 6,326,193).

Lentiviral vectors have been well known for their capability of transferring genes into human T cells with high efficiency but expression of the vector-encoded genes is dependent on the internal promoter that drives their expression. A strong promoter is particularly important for the third or fourth generation of CARs that bear additional co-stimulatory domains or genes encoding proliferative cytokines as increased CAR body size does not guarantee equal levels of expression. There are a wide range of promoters with different strength and cell-type specificity. Gene therapies using CAR T cells rely on the ability of T cells to express adequate CAR body and maintain expression over a long period of time. The EF-1α promoter has been commonly selected for the CAR expression.

The present disclosure provides an expression vector containing a strong promoter for high level gene expression in T cells or NK cells. In further embodiment, the present disclosure provides a strong promoter useful for high level expression of CARs in T cells or NK cells. In particular embodiments, a strong promoter relates to the SFFV promoter, which is selectively introduced in an expression vector to obtain high levels of expression and maintain expression over a long period of time in T cells or NK cells. Expressed genes prefer CARs, T cell co-stimulatory factors and cytokines used for immunotherapy.

One example of a suitable promoter is the immediate early cytomegalovirus (CMV) promoter sequence. This promoter sequence is a strong constitutive promoter sequence capable of driving high levels of expression of any polynucleotide sequence operatively linked thereto. Another example of a suitable promoter is Elongation Growth Factor-1 a (EF-1 a). However, other constitutive promoter sequences may also be used, including, but not limited to the simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the hemoglobin promoter, and the creatine kinase promoter. Further, the disclosure should not be limited to the use of constitutive promoters, inducible promoters are also contemplated as part of the disclosure. The use of an inducible promoter provides a molecular switch capable of turning on expression of the polynucleotide sequence, which is operatively linked when such expression is desired, or turning off the expression when expression is not desired. Examples of inducible promoters include, but are not limited to a metalothionine promoter, a glucocorticoid promoter, a progesterone promoter, and a tetracycline promoter.

Expression of chimeric antigen receptor polynucleotide may be achieved using, for example, expression vectors including, but not limited to, at least one of a SFFV (spleen-focus forming virus) (for example, SEQ ID NO. 23) or human elongation factor 11α (EF) promoter, CAG (chicken beta-actin promoter with CMV enhancer) promoter human elongation factor 1α (EF) promoter. Examples of less-strong/lower-expressing promoters utilized may include, but is not limited to, the simian virus 40 (SV40) early promoter, cytomegalovirus (CMV) immediate-early promoter, Ubiquitin C (UBC) promoter, and the phosphoglycerate kinase 1 (PGK) promoter, or a part thereof. Inducible expression of chimeric antigen receptor may be achieved using, for example, a tetracycline responsive promoter, including, but not limited to, TRE3GV (Tet-response element, including all generations and preferably, the 3rd generation), inducible promoter (Clontech Laboratories, Mountain View, CA) or a part or a combination thereof.

In a preferred embodiment, the promoter is an SFFV promoter or a derivative thereof. It has been unexpectedly discovered that SFFV promoter provides stronger expression and greater persistence in the transduced cells in accordance with the present disclosure.

"Expression vector" refers to a vector including a recombinant polynucleotide comprising expression control sequences operatively linked to a nucleotide sequence to be expressed. An expression vector includes sufficient cis-acting elements for expression; other elements for expression can be supplied by the host cell or in an in vitro expression system. Expression vectors include all those known in the art, such as cosmids, plasmids (e.g., naked or contained in liposomes) and viruses (e.g., lentiviruses, retroviruses, adenoviruses, and adeno-associated viruses) that incorporate the recombinant polynucleotide. The expression vector may be a bicistronic or multicistronic expression vector. Bicistronic or multicistronic expression vectors may include (1) multiple promoters fused to each of the open reading frames; (2) insertion of splicing signals between genes; fusion of genes whose expressions are driven by a single promoter; (3) insertion of proteolytic cleavage sites between genes (self-cleavage peptide); and (iv) insertion of internal ribosomal entry sites (IRESs) between genes.

In one embodiment, the disclosure provides an engineered cell having at least one chimeric antigen receptor polypeptide or polynucleotide.

An "engineered cell" means any cell of any organism that is modified, transformed, or manipulated by addition or modification of a gene, a DNA or RNA sequence, or protein or polypeptide. Isolated cells, host cells, and genetically engineered cells of the present disclosure include isolated immune cells, such as NK cells and T cells that contain the DNA or RNA sequences encoding a chimeric antigen receptor or chimeric antigen receptor complex and express the chimeric receptor on the cell surface. Isolated host cells and engineered cells may be used, for example, for enhancing an NK cell activity or a T lymphocyte activity, treatment of cancer, and treatment of infectious diseases.

In an embodiment, the engineered cell includes immunoregulatory cells. Immunoregulatory cells include T-cells, such as CD4 T-cells (Helper T-cells), CD8 T-cells (Cytotoxic T-cells, CTLs), and memory T cells or memory stem cell T cells. In another embodiment, T-cells include Natural Killer T-cells (NK T-cells).

In an embodiment, the engineered cell includes Natural Killer cells. Natural killer cells are well known in the art. In one embodiment, natural killer cells include cell lines, such as NK-92 cells. Further examples of NK cell lines include NKG, YT, NK-YS, HANK-1, YTS cells, and NKL cells.

NK cells mediate anti-tumor effects without the risk of GvHD and are short-lived relative to T-cells. Accordingly, NK cells would be exhausted shortly after destroying cancer cells, decreasing the need for an inducible suicide gene on CAR constructs that would ablate the modified cells.

In accordance with the present disclosure, it was surprisingly found that NK cells provide a readily available cell to be engineered to contain and express the chimeric antigen receptor polypeptides disclosed herein.

Allogeneic or autologous NK cells induce a rapid immune response but disappear relatively rapidly from the circulation due to their limited lifespan. Thus, applicants surprisingly discovered that there is reduced concern of persisting side effects using CAR cell based therapy.

According to one aspect of the present disclosure, NK cells can be expanded and transfected with CAR polynucleotides in accordance to the present disclosure. NK cells can be derived from cord blood, peripheral blood, iPS cells and embryonic stem cells. According to one aspect of the present disclosure, NK-92 cells may be expanded and transfected with CAR. NK-92 is a continuously growing cell line that has features and characteristics of natural killer (NK) cells (Arai, Meagher et al. 2008). NK-92 cell line is IL-2 dependent and has been proven to be safe(Arai, Meagher et al. 2008) and feasible. CAR expressing NK-92 cells can be expanded in the serum free-medium with or without co-culturing with feeder cells. A pure population of NK-92 carrying the CAR of interest may be obtained by sorting.

In one embodiment, engineered cells include allogeneic T cells obtained from donors that are modified to inactivate components of TCR (T cell receptor) involved in MHC recognition. As a result, TCR deficient T cells would not cause graft versus host disease (GVHD).

In some embodiments, the engineered cell may be modified to prevent expression of cell surface antigens. For example, an engineered cell may be genetically modified to delete the native CD45 gene to prevent expression and cell surface display thereof.

In some embodiments, the engineered cell includes an inducible suicide gene ("safety switch") or a combination of safety switches, which may be assembled on a vector, such as, without limiting, a retroviral vector, lentiviral vector, adenoviral vector or plasmid. Introduction of a "safety switch" greatly increases safety profile and limits on-target or off-tumor toxicities of the compound CARs. The "safety switch" may be an inducible suicide gene, such as, without limiting, caspase 9 gene, thymidine kinase, cytosine deaminase (CD) or cytochrome P450. Other safety switches for elimination of unwanted modified T cells involve expression of CD20 or CD52 or CD19 or truncated epidermal growth factor receptor in T cells. All possible safety switches have been contemplated and are embodied in the present disclosure.

In some embodiments, the suicide gene is integrated into the engineered cell genome.

In one embodiment, the present disclosure provides an engineered cell having a CD45 chimeric antigen receptor polynucleotide. In one embodiment, the CD45 CAR polypeptide includes SEQ ID NO. 13 and corresponding polynucleotide sequence SEQ ID NO. 14. In another embodiment, the CD45 CAR polypeptide includes SEQ ID NO. 15, and corresponding polynucleotide sequence SEQ ID NO. 16. In another embodiment, the CD45 CAR polypeptide includes SEQ ID NO. 17, and corresponding polynucleotide sequence SEQ ID NO. 18.

In particular embodiments, the engineered cell includes CD45 CAR linked to IL15/IL-15sushi via the P2A cleavage sequence. A polypeptide providing this embodiment includes SEQ ID No. 43 and corresponding polynucleotide sequence SEQ ID No. 44.

In particular embodiments, the engineered cell includes CD45 CAR linked to 4-1BBL (CD137L) via the P2A cleavage sequence. A polypeptide providing this embodiment includes SEQ ID No. 42 and corresponding polynucleotide sequence SEQ ID No. 41.

In one embodiment, an engineered cell includes a CD22 CAR composing of a chimeric antigen receptor polypeptide having a CD22 antigen recognition domain. In one embodiment, this engineered cell includes a polypeptide of SEQ ID NO. 130 and corresponding polynucleotide of SEQ ID NO. 131.

Multiple CAR Units

In one embodiment, the present disclosure provides an engineered cell having at least two distinct or separate CAR units. The two CAR units may be complete CAR units or incomplete CAR units. As used herein, "distinct CAR polypeptide" and "distinct CAR polypeptide unit" are used interchangeably.

The present disclosure provides chimeric antigen receptor polypeptides having a signal peptide, antigen recognition domain, a hinge region, a transmembrane domain, a signaling domain, and at least one co-stimulatory domain, defining a CAR unit or a complete CAR unit. As used herein, an incomplete CAR unit includes a polypeptide having a signal peptide, antigen recognition domain, a hinge region, a transmembrane domain, and a signaling domain or at least one co-stimulatory domain. An incomplete CAR unit will not contain a signaling domain and at least one co-stimulatory domain, but one or the other.

In one embodiment, the present disclosure provides an engineered cell having a first chimeric antigen receptor polypeptide having a first antigen recognition domain and a co-stimulatory domain (first incomplete CAR unit); and a second chimeric antigen receptor polypeptide having a second antigen recognition domain and a signaling domain (second incomplete CAR unit); wherein the first antigen recognition domain is different than the second antigen recognition domain.

Therefore, an engineered cell having two incomplete CAR units will only be fully activated when both target antigens are bound to the antigen recognition domain. This strategy provides added specificity in that the engineered cells are not fully activated until targets are bound at the antigen recognition domain of each incomplete CAR unit.

Furthermore, in embodiments wherein an engineered cell includes two incomplete CAR units, one of the antigen recognition domains may be specific for and bind streptavidin, biotin, HIS, MYC, HA, agarose, V5, Maltose, GST, GFP, CD52, CD20, 4-1BB, or CD28.

As used herein, compound CAR (cCAR) or multiple CAR refers to an engineered cell having at least two complete and distinct chimeric antigen receptor polypeptides. As used herein, a "distinct chimeric antigen receptor polypeptide" has a unique antigen recognition domain, a signal peptide, a hinge region, a transmembrane domain, at least one costimulatory domain, and a signaling domain. Therefore, two unique chimeric antigen receptor polypeptides will have different antigen recognition domains. The signal peptide, hinge region, transmembrane domain, at least one costimulatory domain, and signaling domain may be the same or different between the two distinct chimeric antigen receptor polypeptides. As used herein, a chimeric antigen receptor (CAR) unit refers to a distinct chimeric antigen receptor polypeptide, or a polynucleotide encoding for the same.

As used herein, a unique antigen recognition domain is one that is specific for or targets a single target, or a single epitope of a target.

In some embodiments. the compound CAR targets the same antigen. For example, cCAR targets different epitopes or parts of a single antigen. In some embodiments, each of the CAR units present in the compound CAR targets different antigen specific to the same or different disease condition or side effects caused by a disease condition.

In some embodiments, the compound CAR targets two different antigens.

Creation of compound CARs bearing different CAR units can be quite challenging: (1) CAR-CAR interactions might have a deleterious effect and an appropriate CAR design is a key to offset this effect; (2) a compound CAR in a single construct could increase the length of the expression cassette, which may cause the reduction of the viral titer and level of protein expression; (3) an appropriate design to include various CAR body elements particularly to select a strategy to express multiple CARs in a single vector is required; (4) A strong promoter is particularly important for a compound CAR that bears additional units of CAR; (5) The hinge region in the CAR needs to be designed so that interaction of the hinge region between each CAR unit is avoided preferably; (6) two or more units of CARs expressing in a cell may cause toxic effects (CAR-CAR interaction). Applicants herein provide novel and surprising CAR compositions and methods to overcome these hurdles.

In one embodiment, the present disclosure provides an engineered cell having multiple CAR units. This allows a single engineered cell to target multiple antigens. Targeting multiple surface markers or antigens simultaneously with a multiple CAR unit prevents selection of resistant clones and reduces tumor recurrence. Multiple CAR T cell immunotherapies, with each individual component CAR comprising various domains and activation sites has not yet been developed for any malignancies.

In one aspect of the present disclosure, cCAR includes multiple CAR units. In some embodiments, cCAR includes at least two CAR units. In another embodiment, the cCAR includes at least three CAR units. In another embodiment, the cCAR includes at least four units.

In one embodiment, the present disclosure provides an engineered cell having at least two distinct chimeric antigen receptor polypeptides, each having a different antigen recognition domain.

In one embodiment, the engineered cell having at least two distinct chimeric antigen receptor polypeptides is a T-cell. The T-cell may be engineered so that it does not express a cell surface antigen. For example, a T-cell may be engineered so that it does not express a CD45 cell surface antigen.

In a preferred embodiment, the engineered cell having at least two distinct chimeric antigen receptor polypeptides is a primary NK cell isolated from the peripheral blood or cord blood and NK-92 cells, such that it is administered "off-the-shelf" to any mammal with a disease or cancer.

In one embodiment, the engineered cell includes (i.) a first chimeric antigen receptor polypeptide comprising a first antigen recognition domain, a first signal peptide, a first hinge region, a first transmembrane domain, a first co-stimulatory domain, and a first signaling domain; and (ii.) a second chimeric antigen receptor polypeptide comprising a second antigen recognition domain, a second signal peptide, a second hinge region, a second transmembrane domain, a second co-stimulatory domain, and a second signaling domain. The first antigen recognition domain is different from the second antigen recognition domain.

In a preferred embodiment, each engineered CAR unit polynucleotide has different nucleotide sequences in order to avoid homologous recombination.

In one embodiment, the target of the first antigen recognition domain is selected from the group consisting of ROR1, PSMA, PSCA (prostate stem cell antigen), MAGE A3, Glycolipid, glypican 3, F77, GD-2, WT1, CEA, HER-2/neu, IL13RQ2, Met, mesothelin, EGFR, EGFRvIII, MUC16, NKG2D ligands, thyroglobulin, MAGE-3, MAGE-4, MAGE-5, MAGE-6, alpha-fetoprotein, CA 19-9, CA 72-4, NY-ESO, FAP, ErbB, c-Met, MART-1, MUC1, MUC2, MUC3, MUC4, MUC5, CD30, EGFRvIII, CD33, CD123, CLL-1, immunoglobin kappa and lambda, CD38, CD52, CD19, CD20, CD22, CD38, BCMA, CS1, BAFF receptor, TACI, CD3, CD4, CD8, CD5, CD7, CD2, CD45, CD70 CD138, interleukin 6 receptor, NY-ESO-1, alpha fetoprotein (AFP), glypican-3 (GPC3), BAFF-R, BCMA, TACI, LeY, CD4, CD5, CD13, CD14, CD15 CD19, CD20, CD22, CD33, CD41, CD61, CD64, CD68, CD117, CD123, CD138, CD267, CD269, CD38, Flt3 receptor, CLL-1, and CS1; and the target of the second recognition domain is selected from the group consisting of ROR1, PSMA, PSCA (prostate stem cell antigen), MAGE A3, Glycolipid, glypican 3, F77, GD-2, WT1, CEA, HER-2/neu, IL13RQ2, Met, mesothelin, EGFR, EGFRvIII, MUC16, NKG2D ligands, thyroglobulin, MAGE-3, MAGE-4, MAGE-5, MAGE-6, alpha-fetoprotein, CA 19-9, CA 72-4, NY-ESO, FAP, ErbB, c-Met, MART-1, MUC1, MUC2, MUC3, MUC4, MUC5, CD30, EGFRvIII, CD33, CD123, CLL-1, immunoglobin kappa and lambda, CD38, CD52, CD19, CD20, CD22, CD38, BCMA, CS1, BAFF receptor, TACI, CD3, CD4, CD8, CD5, CD7, CD2, CD45, CD70 and CD138.

In one embodiment, the engineered cell includes a first chimeric antigen receptor polypeptide having a CD19 antigen recognition domain and second chimeric antigen receptor polypeptide having a CD20 recognition domain. In one embodiment, this engineered cell includes a polypeptide of SEQ ID NO. 3 and corresponding polynucleotide of SEQ ID NO. 4.

In one embodiment, the engineered cell includes a first chimeric antigen receptor polypeptide having a CD19 antigen recognition domain and second chimeric antigen receptor polypeptide having a CD22 antigen recognition domain. In one embodiment, this engineered cell includes a polypeptide of SEQ ID NO. 5 and corresponding polynucleotide of SEQ ID NO. 6.

In one embodiment, the engineered cell includes a first chimeric antigen receptor polypeptide having a CD19 antigen recognition domain and second chimeric antigen receptor polypeptide having a CD123 antigen recognition domain. In one embodiment, this engineered cell includes a polypeptide of SEQ ID NO. 7 and corresponding polynucleotide of SEQ ID NO. 8.

In one embodiment, the engineered cell includes a first chimeric antigen receptor polypeptide having a BCMA antigen recognition domain and second chimeric antigen receptor polypeptide having a CD19 antigen recognition domain.

In one embodiment, the engineered cell includes a first chimeric antigen receptor polypeptide having a BAFFR antigen recognition domain and second chimeric antigen receptor polypeptide having a CD19 antigen recognition domain.

In one embodiment, the engineered cell includes a first chimeric antigen receptor polypeptide having a BCMA antigen recognition domain and second chimeric antigen receptor polypeptide having a CS1 antigen recognition domain.

In one embodiment, the engineered cell includes a first chimeric antigen receptor polypeptide having a CD33 antigen recognition domain and second chimeric antigen receptor polypeptide having a CLL-1 antigen recognition domain.

In one embodiment, the engineered cell includes a first chimeric antigen receptor polypeptide having a CD4 antigen recognition domain and second chimeric antigen receptor polypeptide having a CLL-1 antigen recognition domain.

In one embodiment, the engineered cell includes a first chimeric antigen receptor polypeptide having a CD4 antigen recognition domain and second chimeric antigen receptor polypeptide having a CD123 antigen recognition domain.

In one embodiment, the engineered cell includes a first chimeric antigen receptor polypeptide having a CD19 antigen recognition domain and second chimeric antigen receptor polypeptide having a CS-1 antigen recognition domain.

In one embodiment, the engineered cell includes a first chimeric antigen receptor polypeptide having a CD33 antigen recognition domain and second chimeric antigen receptor polypeptide having a CD123antigen recognition domain. In one embodiment, this engineered cell includes a polypeptide of SEQ ID NO. 9 and corresponding polynucleotide of SEQ ID NO. 10. In another embodiment, this engineered cell includes a polypeptide of SEQ ID NO. 11 and corresponding polynucleotide of SEQ ID NO. 12.

In one embodiment, the engineered cell includes a first chimeric antigen receptor polypeptide having a BAFF-R antigen recognition domain and second chimeric antigen receptor polypeptide having a CS1antigen recognition domain.

In one embodiment, the engineered cell includes a first chimeric antigen receptor polypeptide having a CD269 antigen recognition domain and second chimeric antigen receptor polypeptide having a CS1 antigen recognition domain. In one embodiment, the engineered cell includes a polypeptide including SEQ ID NO. 19 and corresponding polynucleotide SEQ ID NO. 20. In one embodiment, the engineered cell includes a polypeptide including SEQ ID NO. 21 and corresponding polynucleotide SEQ ID NO. 22.

In one embodiment, the engineered cell includes a first chimeric antigen receptor polypeptide having a CD33 antigen recognition domain and second chimeric antigen receptor polypeptide having a CD123 antigen recognition domain.

In one embodiment, each CAR unit includes the same or different hinge region. In another embodiment, each CAR unit includes the same or different transmembrane region. In another embodiment, each CAR unit includes the same or different intracellular domain.

In one embodiment, each CAR unit includes the CD3 zeta chain signaling domain.

In one embodiment, each distinct CAR unit includes different co-stimulatory domains to avoid interaction. For example, the first chimeric antigen receptor polypeptide includes a 4-BB co-stimulatory domain; and the second chimeric antigen receptor polypeptide includes a CD28 co-stimulatory domain.

In another embodiment, the hinge region is designed to exclude amino acids that may cause undesired intra- or intermolecular interactions. For example, the hinge region may be designed to exclude or minimize cysteine residues to prevent formation of disulfide bonds. In another embodiment, the hinge region may be designed to exclude or minimize hydrophobic residues to prevent unwanted hydrophobic interactions.

Compound CAR can perform killing independently or in combination. Multiple or compound CAR includes same or different hinge region, same or different transmembrane, same or different co-stimulatory and same or different intracellular domains. Preferably, the hinge region is selected to avoid the interaction site.

The compound CAR of the present disclosure may target same or different tumor populations in T or NK cells. The first CAR, for example, may target the bulky tumor population and the next or the second CAR, for example, may eradicate cancer or leukemic stem cells, to avoid cancer relapses.

In accordance with the present disclosure it was surprisingly found that the compound CAR in a T or NK cells targeting different or same tumor populations combat tumor factors causing cancer cells resistant to the CAR killing activity, thereby producing down regulation of the target antigen from the cancer cell surface. It was also surprisingly found that this enables the cancer cell to "hide" from the CAR therapy referred to as "antigen escape" and tumor heterogeneity, by which different tumor cells can exhibit distinct surface antigen expression profiles.

Engineered Cell Having CAR Polypeptide and Enhancer

In another embodiment, the present disclosure provides an engineered cell having at least one chimeric antigen receptor polypeptide and an enhancer.

In one embodiment, the present disclosure provides an engineered cell having at least two distinct chimeric antigen receptor polypeptides and an enhancer.

As used herein, an enhancer includes a biological molecule that promotes or enhances the activity of the engineered cell having the chimeric antigen receptor polypeptide. Enhancers include cytokines. In another embodiment, enhancers include IL-2, IL-7, IL-10, IL-12, IL-15, IL-18, IL-21, PD-1, PD-L1, CSF1R, CTAL-4, TIM-3, and TGFR beta, receptors for the same, and functional fragments thereof.

Enhancers may be expressed by the engineered cell described herein and displayed on the surface of the engineered cell or the enhancer may be secreted into the surrounding extracellular space by the engineered cell. Methods of surface display and secretion are well known in the art. For example, the enhancer may be a fusion protein with a peptide that provides surface display or secretion into the extracellular space.

The effect of the enhancer may be complemented by additional factors such as enhancer receptors and functional fragments thereof. The additional factors may be co-expressed with the enhancer as a fusion protein, or expressed as a separate polypeptide and secreted into the extracellular space.

Enhancers can be cytokines secreted from engineered CAR cells and are designed to co-express with the CAR polypeptide. A massive release occurs upon CAR engagement of cognate antigen. Inflammatory cells surrounding tumor cells have a significant correlation with cancer cell progression and metastasis. Inflammatory cells could include T cells and innate immune response cells, such as NK cells, macrophages, and dendritic cells and their proliferation and anti-tumor activity are regulated by cytokines. CAR cells such as CAR T or NK cells bind to targeted cancer cells and trigger massive secretion of enhancers from the expansion of CAR T/NK cells. The secreted enhancers efficiently promote survival, differentiation and activation of immune response cells against cancer cells. The co-expression of an enhancer(s) with CAR can supplement the defect that CAR T or NK cells are unable to eliminate non-targeting cancer cells (FIG. 78).

CAR cells can be a carrier of cytokines, and cytokines can be delivered to targeted cancer sites by CAR cells to reduce systemic toxicity with high-dose exogenous cytokines (FIG. 78).

To improve sustained survival or long-lived persistence of CAR cells, a membrane bound enhancer (s) can be co-expressed with CAR to improve CAR persistency.

In one embodiment, the enhancer is IL-15. In this instance, the additional factor described above is the IL-15 receptor, and functional fragments thereof. Functional fragments include the IL-15 receptor, IL-15RA, and the sushi domain of IL-15RA (IL-15sushi). Soluble IL-15RA or IL15sushi profoundly potentiates IL-15 functional activity by prevention of IL-15 degradation. Soluble IL-15/IL-15RA or IL-15/IL-15sushi complexes are stable and much more stimulatory than IL-15 alone in vivo.

In one embodiment, IL-15 is co-expressed as a fusion protein with at least one of IL-15 receptor, IL-15RA, and the sushi domain of IL-15RA (IL-15sushi). In one embodiment, the IL-15 receptor, IL-15RA, or the sushi domain of IL-15RA (IL-15sushi) is at the N-terminus of IL-15. In another embodiment, the IL-15 receptor, IL-15RA, or the sushi domain of IL-15RA (IL-15sushi) is at the C-terminus of IL-15. As used herein, IL-15/IL-15 sushi denotes that IL-15 sushi is at the C-terminus of IL-15 in a fusion protein; and IL-15sushi/il-15 denotes that IL-15 sushi is at the N-terminus of IL-15 in a fusion protein.

In some embodiments, IL-15 can be fused to the soluble domain of IL-15Rα (sushi) to form stable heterodimeric complexes (IL-15/IL-15sushi) in solution and this complex exhibits increased biological activity compared to the non-complexed IL-15.

In some embodiments, IL-15 can be a IL-15N72D mutant and fused to the soluble domain of IL-15Rα (sushi) to form stable complexes in solution and this complex exhibits increased biological activity compared to the non-complexed IL-15. The Mutant IL-15N72D can increase IL-15 biological activity (US20120177595 A1).

In some embodiments, IL-15 and the IL-15 receptor or functional fragments thereof polypeptide is on a single polypeptide molecule and is separated by a peptide linker, the peptide linker may be 1-25 amino acid residues in length, 25-100 amino acid residues in length, or 50-200 amino acid residues in length. This linker may include a high efficiency cleavage site described herein.

An example of a suitable sushi domain includes a CAR construct, SEQ ID NO. 1. In accordance with the present disclosure, any chimeric antigen receptor polypeptide disclosed herein may be co-expressed with the Human Interleukin 15 with human interleukin 2 signal peptide SEQ ID NO. 2.

Interleukin (IL)-15 and its specific receptor chain, IL-15Rα (IL-15-RA) play a key functional role in various effector cells, including NK and CD8 T cells. CD8+ T cells can be modified to express autocrine growth factors including, but not limited to, IL-2, 11-7, IL21 or IL-15, to sustain survival following transfer in vivo. Without wishing to be bound by theory, it is believed that IL-15 overcomes the CD4 deficiency to induce primary and recall memory CD8T cells. Overexpression of IL-15-RA or an IL-15 IL-RA fusion on CD8 T cells significantly enhances its survival and proliferation in-vitro and in-vivo. In some embodiments, CD4CAR or any CAR is co-expressed with at least one of IL-15, IL-15RA and IL-15/IL-15RA or IL15-RA/IL-15 or IL-15/IL-15 sushi, or a part or a combination thereof, to enhance survival or proliferation of CAR T or NK, and to improve expansion of memory CAR CD8+ T cells.

The present disclosure provides an engineered cell having a CAR polypeptide as described herein and at least one of IL-15, IL-15RA, IL-15sushi, IL-15/IL-15RA, IL15-RA/IL-15, IL-15/IL-15sushi, IL15sushi/IL-15, fragment thereof, a combination thereof, to enhance survival or persistence or proliferation of CAR T or NK for treating cancer in a patient.

In another embodiment, the present disclosure provides an engineered cell having at least one of recombinant IL-15, IL-15RA, IL-15sushi, IL-15/IL-15RA, IL15-RA/IL-15, IL-15/IL-15sushi, IL15sushi/IL-15, functional fragment thereof, and combination thereof; and at least one distinct CAR polypeptide wherein the antigen recognition domain includes NY-ESO-1, alpha fetoprotein (AFP), glypican-3 (GPC3), BCMA, BAFF-R, BCMA, TACI, LeY, CD5, CD7, CD2, CD3, CD4, CD45, CD13, CD14, CD15, CD19, CD20, CD22, CD33, CD41, CD61, CD64, CD68, CD117, CD123, CD138, CD267, CD269, CD38, Flt3 receptor, ROR1, PSMA, MAGE A3, Glycolipid, F77, GD-2, WT1, CEA, HER-2/neu, MAGE-3, MAGE-4, MAGE-5, MAGE-6, CA 19-9, CA 72-4, NY-ESO, FAP, ErbB, c-Met, MART-1, CD30, EGFRvIII, immunoglobin kappa and lambda, CD38 and CS1. The target antigens can also include viral or fungal antigens, such as E6 and E7 from the human papillomavirus (HPV) or EBV (Epstein Barr virus) antigens. In further embodiment, the antigen recognition polypeptides (scFv) and corresponding polynucleotides for CD2, CD3, CD5, CD7, and CD52 are described in PCT Application NO. PCT/US2016/39306, the contents of which are incorporated herein by reference.

Enhancers for CAR Functions
IL-15/IL15sushi Enhancer

In one embodiment, A CAR construct with IL-15/IL15sushi enhancer is shown in FIG. 94, A CAR is equipped with secreting IL-15/IL-15sushi complexes. A CAR with IL-15/IL-15 sushi is linked with the P2A self-cleaving sequence. The IL-15/IL-15sushi portion is composed of IL-2 signal peptide fused to IL-15 and linked to the sushi domain of IL-15 alpha receptor via an amino acid linker. The linker may be of varying length. In one embodiment, the linker is 1-20 amino acids in length, in another embodiment, the linker is 20-40 amino acids in length. For example, the linker may be a 26-amino acid poly-proline linker. CAR has scFv, costimulatory domain (including, but not limited to CD28 or 4-1BB) and intracellular signaling, CD3 zeta chain. The IL-15 signal peptide in the IL-15 is replaced with IL-2 signal peptide (leader sequence), a strong signal peptide to provide a high efficiency of IL-15/IL-15sushi secretion.

The IL-15 can be a variant, IL-15N72D described in elsewhere, U.S. Pat. No. 8,507,222. The contents of which are herein incorporated by reference.

The potential disadvantages of using NK cells in CAR therapy include a lack of persistency that may reduce long-term efficacy.

Finding matching donor T cells for generating CAR T cells could be a challenge as un-matched T cells could attach to the recipient's tissues, resulting in graft vs. host disease (GVHD).

In one embodiment, the present disclosure comprises a method of generating chimeric antigen receptor (CAR)-modified NK cells with long-lived or long persistency in vivo potential for treating a disease. Surprisingly, it is found that CAR NK cells co-expressing IL-15/IL-15sushi can extend survival for a long period of time.

Surprisingly, it is found that CAR NK cells co-expressing IL-15/IL-15sushi can extend survival for at least 4 weeks or at least two months or at least three months.

In further embodiment, the extension of CAR NK cell survival can be achieved by co-expressing the IL-15/IL-15.

In some embodiments, a CAR NK cell co-expressing IL-15/IL-15sushi can be scaled up and used as an off-the-shelf product.

In one embodiment, a CAR NK cell co-expressing IL-15/IL-15 sushi is capable of continuing supportive cytokine signaling, which is critical to their survival post-infusion in a patient.

In certain embodiments, NK cells can be derived from human peripheral blood mononuclear cells (PBMC), leukapheresis products (PBSC), human embryonic stem cells (hESCs), induced pluripotent stem cells (iPSCs), bone marrow, or umbilical cord blood.

In one embodiment, the present disclosure provides a method related to that NK cells targeting tumor cells can be a carrier to delivery an enhancer, IL-15/IL-15 sushi to the tumor micro-environment. CAR NK cells are engineered to co-express a secretory IL-15/IL-15 sushi. Engineered CAR NK cells in tumor microenvironment, target tumor cells, binding to the CAR targeting antigen, and triggering lysis of tumor cells and massive secretion of soluble IL-15/IL-15 sushi from the expansion of CAR NK cells. The secreting IL-15/IL-15 sushi can further extend survival of CAR NK cells for a long period of time.

In particular embodiments, elimination of tumor can be achieved by combination of at least one or more of the following steps:
(1) binding of a CAR engineered NK cell disclosed herein to a portion of tumor cells by targeting CAR antigen(s);
(2) Triggering of a massive secretion of IL-15/IL-15 sushi from expansion of CAR NK cells, which co-express this molecule;
(3) Recruiting and stimulating a variety of innate and adaptive immune cells against tumor;
(4) Secreting IL-15/IL-15 can extend survival or persistency of CAR NK cells for at least 4 weeks or at least two months or at least three months or a year.
(5) Reducing tumor suppression that is present in tumor by administration of a checkpoint blockage such as PD-L1 and CTLA-4 inhibitor.

IL-15/IL15sushi Anchor Enhancers

In one embodiment, a CAR construct with IL-15/IL-15sushi anchor is shown in FIG. 95. A CAR IL-15/IL15sushi anchor construct consists a SFFV promoter driving the expression of a CAR and an IL-15/IL-15sushi anchor (also called anchor) linked by a P2A peptide. Upon cleavage of this P2A peptide, IL-15/IL-15 anchor CAR splits to a CAR and an IL-15/IL-15suchi anchor. The IL-15/IL-15sushi portion of anchor is composed of IL-2 signal peptide fused to IL-15 and linked to sushi domain of IL-15 alpha receptor via an amino acid linker. The linker may be of varying length. In one embodiment, the linker is 1-20 amino acids in length, in another embodiment, the linker is 20-40 amino acids in length. For example, the linker may be a 26-amino acid poly-proline linker. Both CAR and anchor comprise a hinge (H) region, a transmembrane domain (TM). CAR also has scFv, costimulatory domain (including, but not limited to CD28 or 4-1BB) and intracellular signaling, CD3 zeta chain while anchor does not bear these components. IL-15/IL-15sushi anchor provides a synergistic effect of T cell activation or anti-tumor activity with CD28 or 4-1BB. CAR is more powerful when equipped with IL-15/IL-15sushi anchor.

The IL-15 can be a variant, IL-15N72D described in elsewhere, U.S. Pat. No. 8,507,222. The contents of which are herein incorporated by reference.

In one embodiment, the present disclosure comprises a method of generating chimeric antigen receptor (CAR)-modified NK cells with long-lived or long persistency in vivo potential for treating a disease. Surprisingly, it is found that CAR NK cells co-expressing IL-15/IL-15sushi anchor can extend survival for a long period of time.

Surprisingly, it is found that CAR NK cells co-expressing IL-15/IL-15sushi anchor can extend survival for at least 4 weeks or at least two months or at least three months.

In further embodiment, the extension of CAR NK cell survival can be achieved by co-expressing the IL-15/IL-15 anchor.

In some embodiments, a CAR NK cell co-expressing IL-15/IL-15sushi anchor can be scaled up and used as an off-the-shelf product.

In one embodiment, a CAR NK cell co-expressing IL-15/IL-15 sushi anchor is capable of continuing supportive cytokine signaling, which is critical to their survival post-infusion in a patient.

In certain embodiments, NK cells can be derived from human peripheral blood mononuclear cells (PBMC), leukapheresis products (PBSC), human embryonic stem cells (hESCs), induced pluripotent stem cells (iPSCs), bone marrow, or umbilical cord blood.

4-1BBL Enhancer

In another embodiment, a CAR construct with a 4-1BBL enhancer is shown in FIG. 96A. A CAR 4-1BBL construct consists a SFFV promoter driving the expression of a CAR and an enhancer, 4-1BBL (CD137L) linked by a P2A peptide. Upon cleavage of this P2A peptide, A CAR construct with 4-1BBL splits to a CAR polypeptide and the full length of 4-1BBL protein. A CAR includes a leader sequence and scFv, a hinge (H) region, a transmembrane domain (TM). CAR also has costimulatory domain (including, but not limited to, CD28 or 4-1BB) and intracellular signaling, CD3 zeta chain while 4-1BBL does not bear these components. 4-1BBL provides a synergistic effect of T cell activation or anti-tumor activity with CD28 or 4-1BB. CAR is more powerful when equipped with 4-1BBL.

IL-15 Enhancer

A CAR function can be enhanced by incorporating a secreting enhancer, IL-15 shown in FIG. 96B. A CAR 4-IL-15 construct consisted a SFFV promoter driving the expression of a CAR and an enhancer, IL-15 linked by a P2A peptide. Upon cleavage of this P2A peptide, A CAR construct with IL-15 splits to a CAR polypeptide and the full length of IL-15 protein. A CAR includes a leader sequence and scFv, a hinge (H) region, a transmembrane domain (TM). CAR also has costimulatory domain (including, but not limited to, CD28 or 4-1BB) and intracellular signaling, CD3 zeta chain while IL-15 does not bear these components. Secreting IL-15 provides a synergistic effect of T cell activation or anti-tumor activity with CD28 or 4-1BB. CAR is more powerful when secreting IL-15. The IL-15 signal peptide in the IL-15 was replaced with IL-2 signal peptide (leader sequence), a strong signal peptide to provide a high efficiency of IL-15 secretion.

In some embodiments, the engineered cell includes at least one enhancer. In such embodiments, CAR polypeptide and enhancers are expressed in a single polypeptide molecule having two high efficiency cleavage sites. In one embodiment, the two high efficiency cleavage sites are different. In another embodiment, the high efficiency cleavage sights are the same. In one embodiment, a CAR polypeptide is expressed with 4-1BBL and IL-15/IL-sushi enhancers on a single polypeptide molecule, and P2A and T2A high efficiency cleavage sites are used. An example of such an embodiment is depicted in FIG. 98F.

In one embodiment, the present disclosure comprises a method of generating chimeric antigen receptor (CAR)-modified NK cells with long-lived or long persistency in vivo potential for treating a disease. Surprisingly, it is found that CAR NK cells co-expressing IL-15 can extend survival for a long period of time.

Surprisingly, it is found that CAR NK cells co-expressing IL-15 can extend survival for 4 weeks or two months or three months.

In further embodiment, the extension of CAR NK cell survival can be achieved by co-expressing the IL-15.

In some embodiments, a CAR NK cell co-expressing IL-15 can be scaled up and used as an off-the-shelf product.

In certain embodiments, NK cells can be derived from human peripheral blood mononuclear cells (PBMC), leukapheresis products (PBSC), human embryonic stem cells (hESCs), induced pluripotent stem cells (iPSCs), bone marrow, or umbilical cord blood.

Without wishing to be bound by theory, it is believed that IL-15/IL-15sushi and other types of IL-15 or IL-15RA proteins or protein fragments thereof provide synergistic efficacy of a CAR polypeptide when combined with checkpoint inhibitors or modulators (e.g. anti-PD-1).

In one embodiment, the disclosure provides a CD4 CAR engineered cell that includes IL-15/IL-15sushi (SEQ ID NO. 1), and corresponding polynucleotide (SEQ ID NO. 2). In one embodiment, the present disclosure provides a method of providing long-term durable remission in cancer patients by administering a CD4 CAR engineered cell that includes IL-15/IL-15sushi to a patient in need thereof. Without wishing to be bound by theory, it is believed that co-expression of IL-15/IL-15sushi with a CD4 CAR polypeptide provides long-term durable remission in patients by increasing the sensitivity of CAR recognition of target cancer cells or recruiting innate immune cells to cancer cells.

In one embodiment, the present disclosure provides engineered cell having a CD45 chimeric antigen receptor polypeptide and IL-15/IL-15sushi (SEQ ID NO. 44), and corresponding nucleotides (SEQ ID NO. 43).

In one embodiment, the present disclosure provides a method of providing long-term durable remission in cancer patients by administering a CD45 CAR engineered cell that includes IL-15/IL-15sushi to a patient in need thereof. Without wishing to be bound by theory, it is believed that co-expression of IL-15/IL-15sushi with a CD45 CAR polypeptide provides long-term durable remission in patients by increasing the sensitivity of CAR recognition of target cancer cells or recruiting innate immune cells to cancer cells.

In one embodiment, the engineered cell includes a CD45 chimeric antigen receptor polypeptide and 4-1BBL (SEQ ID NO. 74), and corresponding nucleotides (SEQ ID NO. 73).

In one embodiment, the present disclosure provides a method of providing long-term durable remission in patients suffering from cancer by administering a CD45 CAR engineered cell that co-expresses 4-1BBL to a patient in need thereof. Without wishing to be bound by theory, it is believed that co-expression of 4-1BBL with a CD45 CAR provides long-term durable remission in patients by increasing the persistence of CAR engineered cells.

In one embodiment, the engineered cell includes a CD19 chimeric antigen receptor polypeptide and IL-15/IL-15sushi (SEQ ID NO. 59), and corresponding polynucleotide (SEQ ID NO. 60). In one embodiment, the present disclosure provides a method of providing long-term durable remission in cancer patients by administering a CD19 CAR engineered cell that includes IL-15/IL-15sushi to a patient in need thereof. Without wishing to be bound by theory, it is believed that co-expression of IL-15/IL-15sushi with a CD19 CAR provides long-term durable remission in patients by increasing the sensitivity of CAR recognition of target cancer cells or recruiting innate immune cells to cancer cells.

In one embodiment, the engineered cell includes a CD20 chimeric antigen receptor polypeptide and IL-15/IL-15sushi (SEQ ID NO. 58), and corresponding polynucleotide (SEQ ID NO. 57). In one embodiment, the present disclosure provides a method of providing long-term durable remission in cancer patients by administering a CD20 CAR engineered cell that includes IL-15/IL-15sushi to a patient in need thereof. Without wishing to be bound by theory, it is believed that co-expression of IL-15/IL-15sushi with a CD20 CAR provides long-term durable remission in patients by increasing the sensitivity of CAR recognition of target cancer cells or recruiting innate immune cells to cancer cells.

In one embodiment, the engineered cell includes a CD22 chimeric antigen receptor polypeptide and IL-15/IL-15sushi (SEQ ID NO. 62), and corresponding polynucleotide (SEQ ID NO. 61). In one embodiment, the present disclosure provides a method of providing long-term durable remission in cancer patients by administering a CD22 CAR engineered cell that includes IL-15/IL-15sushi to a patient in need thereof. Without wishing to be bound by theory, it is believed that co-expression of IL-15/IL-15sushi with a CD22 CAR provides long-term durable remission in patients by increasing the sensitivity of CAR recognition of target cancer cells or recruiting innate immune cells to cancer cells.

In one embodiment, the engineered cell includes a CD269 chimeric antigen receptor polypeptide and IL-15/IL-15sushi (SEQ ID NO. 44), and corresponding polynucleotide (SEQ ID NO. 45). In one embodiment, the present disclosure provides a method of providing long-term durable remission in cancer patients by administering a CD269 CAR engineered cell that includes IL-15/IL-15sushi to a patient in need thereof. Without wishing to be bound by theory, it is believed that co-expression of IL-15/IL-15sushi with a CD269 CAR provides long-term durable remission in patients by increasing the sensitivity of CAR recognition of target cancer cells or recruiting innate immune cells to cancer cells as plasma cells or myeloma cells are usually dim CD269 (BCMA) positive.

In one embodiment, the engineered cell includes a CAR, CD4 polypeptide of SEQ ID NO. 90, and corresponding polynucleotide of SEQ ID NO. 89.

In one embodiment, the engineered cell includes a CD4 chimeric antigen receptor polypeptide and IL-15/IL-15sushi (SEQ ID NO. 96), and corresponding polynucleotide (SEQ ID NO. 95). In one embodiment, the present disclosure provides a method of providing long-term durable remission in cancer patients by administering a CD4 CAR engineered cell that includes IL-15/IL-15sushi to a patient in need thereof. Without wishing to be bound by theory, it is believed that co-expression of IL-15/IL-15sushi with a CD4 CAR provides long-term durable remission in patients by increasing the sensitivity of CAR recognition of target cancer cells or recruiting innate immune cells to cancer cells.

In one embodiment, the engineered cell includes a CD4 chimeric antigen receptor polypeptide and IL-15/IL-15RA (membrane bound) (SEQ ID NO. 98), and corresponding polynucleotide (SEQ ID NO. 97). In one embodiment, the present disclosure provides a method of providing long-term durable remission in cancer patients by administering a CD4 CAR engineered cell that includes IL-15/IL-15RA to a patient in need thereof. A single construct contains both CD4CAR and IL-15/IL-15sushi anchor linked by a P2A cleavage peptide. The IL-15/IL-15sushi anchor has the IL-2 signal peptide IL-15 linked to sushi domain followed by a hinge domain (CD8a) and transmembrane domain (IL-15RA). Without wishing to be bound by theory, it is believed that co-expression of IL-15/IL-15RA (membrane bound) with a CD4 CAR provides long-term durable remission in patients by increasing the persistence of CAR engineered cells.

In one embodiment, the engineered cell includes a compound CAR, CD33CD123 polypeptide and IL-15/IL-15sushi (SEQ ID NO. 40), and corresponding polynucleotide (SEQ ID NO. 39). In one embodiment, the present disclosure provides a method of providing long-term durable remission in cancer patients by administering a CD33CD123 compound CAR engineered cell that includes IL-15/IL-15sushi to a patient in need thereof. Without wishing to be bound by theory, it is believed that co-expression of IL-15/IL-15sushi with a CD33CD123 CAR provides long-term durable remission in patients by increasing the sensitivity of CAR recognition of target cancer cells or recruiting innate immune cells to cancer cells.

In one embodiment, the engineered cell includes a compound CAR, CD33CD123 polypeptide and 4-1BBL (SEQ ID NO. 38), and corresponding polynucleotide (SEQ ID NO. 37). In one embodiment, the present disclosure provides a method of providing long-term durable remission in cancer patients by administering a CD33CD123 compound CAR engineered cell that co-expresses 4-1BBL to a patient in need thereof. Without wishing to be bound by theory, it is believed that co-expression of 4-1BBL with a CD33CD123 cCAR provides long-term durable remission in patients by increasing the persistency of cCAR engineered cells.

In one embodiment, the engineered cell includes a BAFF CAR polypeptide with a CD45 leader sequence (SEQ ID NO. 78) and corresponding polynucleotide sequence (SEQ ID NO. 77).

In one embodiment, the engineered cell includes BAFF CAR polypeptide with a CD8a leader sequence (includes SEQ ID NO. 80) and corresponding polynucleotide sequence (SEQ ID NO. 79).

In one embodiment, the engineered cell includes a BAFF CAR polypeptide and IL-15/IL-15sushi (SEQ ID NO. 84), and corresponding polynucleotide (SEQ ID NO. 83).

In one embodiment, the present disclosure provides a method of providing long-term durable remission in cancer patients by administering a BAFF CAR engineered cell that includes IL-15/IL-15sushi to a patient in need thereof. Without wishing to be bound by theory, it is believed that co-expression of IL-15/IL-15sushi with a BAFF CAR provides long-term durable remission in patients by increasing the sensitivity of CAR recognition of target cancer cells or recruiting innate immune cells to cancer cells as BAFF receptor, CD269 (BCMA) is weakly expressed in plasma cells and myeloma cells.

In one embodiment, the engineered cell includes a BAFF CAR polypeptide and 4-1BBL (SEQ ID NO. 82), and corresponding polynucleotide (SEQ ID NO. 81). In one embodiment, the present disclosure provides a method of providing long-term durable remission in cancer patients by administering a BAFF CAR engineered cell co-expresses 4-1BBL to a patient in need thereof. Without wishing to be bound by theory, it is believed that co-expression of 4-1BBL with a BAFF CAR can provide long-term durable remission in patients by increasing the persistence of CAR engineered cells.

In one embodiment, the engineered cell includes a compound CAR, BAFF CD19b polypeptide of SEQ ID NO. 86 and corresponding polynucleotide of SEQ ID NO. 85.

In one embodiment, the present disclosure provides a method of treating an autoimmune disorder in a patients by administering a BAFF CD19b compound CAR engineered cell to a patient in need thereof. Without wishing to be bound by theory, it is believed that the BAFF CD19b compound CAR engineered cells provide a better therapeutic outcome for depletion of B-cells and plasma cells associated with autoimmune disorders.

In one embodiment, the engineered cell includes a APRIL CD19b compound CAR polypeptide of SEQ ID NO. 88 and corresponding polynucleotide of SEQ ID NO. 77.

In one embodiment, the present disclosure provides a method of depleting B-cells and plasma cells in a patient in need thereof by administering a APRIL CD19b compound CAR engineered cell to a patient in need thereof. Without wishing to be bound by theory, it is believed that the APRIL CD19b compound CAR engineered cell can provide a better therapeutic outcome for depletion of B-cells and plasma cells associated with autoimmune disorders.

In one embodiment, the engineered cell includes a compound CAR, CD269 CS1 polypeptide of SEQ ID NO. 48 and corresponding polynucleotide of SEQ ID NO. 47. In one embodiment, the present disclosure provides a method of treating myeloma in a patient by administering a CD269CS1 compound CAR engineered cell to a patient in need thereof. Without wishing to be bound by theory, it is believed that CD269 CS1 compound CAR engineered cells provide a better therapeutic outcome for patients with myeloma, and prevent antigen escape or disease relapse.

In one embodiment, the engineered cell includes a compound CAR, CD269 CD19b polypeptide of SEQ ID NO. 50 and corresponding polynucleotide of SEQ ID NO. 49.

In one embodiment, the present disclosure provides a method of depleting B-cells and plasma cells in patients by administering a CD269 CD19b compound CAR engineered cell to a patient in need thereof. Without wishing to be bound by theory, it is believed that CD269 CD19b compound CAR engineered cells provide a better therapeutic outcome for patients suffering from an autoimmune disorder by depletion of B-cells and plasma cells associated with autoimmune disorders.

In one embodiment, the engineered cell includes another compound CAR, CD269 CD19 polypeptide of SEQ ID NO. 52 and corresponding polynucleotide of SEQ ID NO. 51. In one embodiment, the present disclosure provides a method of depleting B-cells and plasma cells in patients by administering a CD269 CD19 compound CAR engineered cell to a patient in need thereof. Without wishing to be bound by theory, it is believed that CD269 CD19 compound CAR engineered cells provide a better therapeutic outcome in patients suffering from an autoimmune disorder by depletion of B-cells and plasma cells associated with autoimmune disorders.

In one embodiment, the present disclosure provides an engineered cell having a CD19 chimeric antigen receptor polynucleotide. In one embodiment, the CD19 CAR polypeptide includes SEQ ID NO. 54 and corresponding polynucleotide sequence SEQ ID NO. 53. In another embodiment, the CD19 CAR polypeptide includes SEQ ID NO. 56, and corresponding polynucleotide sequence SEQ ID NO. 55.

In one embodiment, the engineered cell includes a CD30 CAR polypeptide, and IL-15/IL-15sushi polypeptide (SEQ ID NO. 100), and corresponding polynucleotide (SEQ ID NO. 99). The targeted disease is malignant Hodgkin lymphoma with cancer cells expressing CD30.

In one embodiment, the present disclosure provides a method of re-activating T-cell and innate immune cells in the tumor microenvironment patients by administering a CD30CAR engineered cell that secretes IL-15/IL-15 complexes to a patient in need thereof. Without wishing to be bound by theory, it is believed that IL-15/IL-15 complexes (e.g. IL-15/IL-15sushi complexes) secreted from engineered cells can re-activate T-cell and innate immune cells in the tumor microenvironment and then restore or augment their anti-tumor immune responses for Hodgkin lymphoma or anaplastic large cell lymphoma.

In one embodiment, the present disclosure provides a method of restoring or augmenting T-cell or innate immune cell activation or expansion including coexpression of IL-15/IL-15sushi with a CAR polypeptide disclosed herein.

In another embodiment, the disclosure provides a chimeric antigen receptor polypeptide having an antigen recognition domain specific for a CD30 antigen.

In one embodiment, the CD30CAR includes at least one-costimulatory domain. In another embodiment, the CD30CAR includes at least two co-stimulatory domains.

In some embodiments, the disclosure includes a method of co-expressing IL-15/IL-15sushi with CD30CAR. In further embodiments, massive secretion of stable, functional IL-15/IL-15sushi complexes occurs upon binding of CAR to target cells.

In another embodiment, the present disclosure provides a method of treating a patient suffering from Hodgkin's lymphoma or a cancer associated with a malignant cell expressing CD30 antigen by administering a CD30 CAR engineered cell to a patient in need thereof. An example of a malignant cells expressing CD30 includes anaplastic large cell lymphoma.

Malignant Hodgkin lymphoma bears CD30+ Reed-Sternberg or Reed-Sternberg like cells, which are surrounded by an overwhelming numbers of T cells and innate immune cells. These T or innate immune cells are immunologically tolerant as they fail to eliminate cancer cells. Therefore, one of critical aspects for treating Hodgkin lymphoma is to re-activate T-cell and innate immune cells in the tumor microenvironment and then restore or augment their anti-tumor immune responses.

In some embodiments, the present disclosure includes a method of co-expression of IL-15/IL-15sushi with a CD30CAR. Engineered CD30CAR T or NK cells bind to targeted cancer cells, trigger massive secretion of IL-15/IL-15sushi from the expansion of CD30CAR T or NK cells, whereby secreting IL-15/IL-15sushi efficiently restore or augment T or innate immune cells against cancer cells to overcome immunosuppressive tumor microenvironment.

In one embodiment, the present disclosure provides a method of providing long-term durable remission in a cancer patient by administering a CD30 CAR engineered cell that co-express IL-15/IL-15sushi to a patient in need thereof. Without wishing to be bound by theory, it is believed that co-expression of IL-15/IL-15sushi with a CD30CAR provides long-term durable remission in patients by increasing the sensitivity of CAR recognition of target cancer cells or recruiting innate immune cells against target cancer cells to overcome immunosuppressive tumor microenvironment.

In some embodiments, the present disclosure provides an engineered cell that co-expresses IL-15/IL-15sushi and a CD30CAR polypeptide. Without wishing to be bound by theory, it is believed that the combination of CD30CAR engineered cell with co-expression of IL-15/IL-15sushi provides synergistic efficacy when combined with checkpoint inhibitors or modulators (e.g. anti-PD-1).

In some embodiments, the present disclosure provides a method of treating Hodgkin's lymphoma in a patient by administering a CD30 CAR engineered cell that co-expresses IL-15/IL-15sushi to a patient in need thereof. Without wishing to be bound by theory, co-expression of CD30CAR polypeptide and IL-15/IL-15sushi provides better outcomes for treatment of Hodgkin's lymphoma or anaplastic large cells than CD30CAR alone as CD30 is not expressed in all cancer cells.

In some embodiments, the present disclosure provides a method of provide long-term durable remission in a cancer patient by administering a APRIL CAR engineered cell that co-expresses IL-15/IL-15sushi to a patient in need thereof. Without wishing to be bound by theory, it is believed that co-expression of IL-15/IL-15sushi with a APRIL CAR polypeptide provides long-term durable remissions in patients by increasing the sensitivity of CAR recognition of target cancer cells or recruiting innate cells to cancer cells. APRIL receptor, CD269 (BCMA) is weakly expressed in plasma cells and myeloma cells.

Steps for Elimination of Tumor by CAR Co-Expressing Secretory IL-15/IL-15sushi (FIG. 78)

In particular embodiments, the present disclosure provides a method for elimination of tumor cells including contacting said tumor cell with a CAR engineered cell that co-expresses IL-2 to destroy said tumor cell.

IL-15 was originally considered as an interleukin-2 (IL-2)-like factor for T and NK cells. Unlike IL-2, IL-15 is a survival factor for memory T cells.

In particular embodiments, elimination of tumor can be achieved by combination of at least one or more of the following steps:
  (1) binding of an CAR engineered T cell or NK cell disclosed herein to a portion of tumor cells by targeting CAR or NK antigen(s);
  (2) Triggering massive secretion of IL-15/IL-15sushi or IL-2 with a prolonged half-life from expansion of CAR T/NK cells, which co-express this molecule;
  (3) Recruiting and stimulating a variety of innate and adaptive immune cells against tumor;
  (4) Reducing tumor suppression that is present in tumor by administration of a checkpoint blockage such as PD-L1 and CTLA-4 inhibitor.

Without wishing to be bound by theory, it is believed that the combination of steps described above provide potent anti-tumor effects via a concerted innate and adaptive immune response.

The engineered cells and methods described herein (FIG. 78) are suitable for the treatment of any cancer wherein specific monoclonal or polyclonal antibodies exist or are capable of being generated in accordance with the current state of the art. In particular, the following cancers have been contemplated and are considered within the scope of the present disclosure, neuroblastoma, lung cancer, melanoma, ovarian cancer, renal cell carcinoma, colon cancer, brain cancer, Hodgkin's lymphoma, B cell lymphoma/leukemia and T cell lymphomaleukemia hepatocellular carcinoma, fibrolamellar carcinoma, hepatoblastoma, undifferentiated embryonal sarcoma and mesenchymal hamartoma of liver, lung-squamous cell carcinoma, testicular nonseminomatous germ cell tumors, liposarcoma, ovarian and extragonadal yolk sac tumors, ovarian choriocarcinoma, teratomas, ovarian clear cell carcinoma, and placental site trophoblastic tumor. All of which have cell surface antigens that may be targeted by the chimeric antigen receptor polypeptides and methods disclosed herein.

In another embodiment, the targeting cells are hepatocellular carcinoma, fibrolamellar carcinoma, hepatoblastoma, undifferentiated embryonal sarcoma and mesenchymal hamartoma of liver, lung-squamous cell carcinoma, testicular nonseminomatous germ cell tumors, liposarcoma, ovarian and extragonadal yolk sac tumors, ovarian choriocarcinoma, teratomas, ovarian clear cell carcinoma, and placental site trophoblastic tumor.

Many tumors escape the specific CAR T/NK killing due to the loss of targeted antigen(s) or CAR T or NK exhaustion. The present disclosure provides a method to overcome this escape. Without wishing to be bound by theory, the present disclosure provides a method of preventing tumor escape by administering a CAR engineered cell having an enhancer or cytokine as disclosed herein, in particular IL-15 or IL-2 to a tumor site by CAR engineered cell. It is believed that this directly stimulates innate and adaptive immune responses. Furthermore, it is believed that IL-15 and/or IL-2 secretion from CAR engineered cells promote the expansion of infused CAR T cells or CAR NK cells and infiltration of immune cells to the tumor site, which is believed to result in tumor destruction.

In embodiments, half-life extension and prolonged therapeutic activity can be established in the presence of the Fc domain, such IL-15Fc or IL-2Fc. For IL-15 cytokine, IL-15/IL-15sushi or IL-15/IL-15sushi Fc is preferred. Fc domain is referred to as the IgG Fc-domain fused to various effector molecules (so-called Fc-fusion proteins).

Single antigen-directed CAR immunotherapy, such as, but not limited to, CD19, CD20, CD22, CD2, CD3, CD4, CD5, CD7, CD33, CD30, CD123, CD45, BCMA, CS1, BAFF, TACI, and APRIL CAR, bears a risk of remission in patients due to the complete loss of target antigen or changes of target antigen expression. On this basis, the present disclosure provides a method of providing long-term durable remission in patients by administering an engineered cell having a CAR polypeptide disclosed herein and co-expression of IL-15/IL-15sushi to increase the sensitivity of CAR recognition of target cancer cells or recruiting innate immune cells to cancer cells.

The large volume of some solid tumors or lymphoma can be difficult for CAR T cells to eradicate the whole tumor. In addition, the immunosuppressive microenvironment needs to be overcome as CAR T cells may end up simply being inactivated or suppressed when contacting tumor.

In some embodiments, the present disclosure provides a method of co-expressing secretory IL-15/IL-15sushi and a chimeric antigen receptor polypeptide in an engineered cell.

In some embodiments, the present disclosure provides a method of increasing CAR engineered cell in vivo half-life by co expressing secretory IL-15/IL-15sushi in said engineered cell. Without wishing to be bound by theory, it is believed that the secreted complexes of IL-15/IL-15sushi are functionally stable and efficiently promote survival of the CAR containing engineered cell.

In some embodiments, the present disclosure provides a method of delivering IL-15/IL-15sushi to targeted cancer sites using CAR as a carrier to promote the proliferation of innate immune response cells against cancer cells, prevent the tumor microenvironment suppression, and reduce systemic toxicity with high-dose exogenous cytokines.

In some embodiments, the present disclosure provides a method of delivering IL-15/IL-15sushi to targeted cancer sites using CAR as a carrier to recruit other effector immune cells to the site and help them to kill cancer cells.

In some embodiments, the present disclosure provides a method of delivering IL-15/IL-15sushi to targeted cancer sites using CAR as a carrier to activate bystander immunity to eradicate cancer cells that lose the antigen for CAR T/NK cells.

Methods of Generating Engineered Cells

Any of the polynucleotides disclosed herein may be introduced into an engineered cell by any method known in the art.

In one embodiment, CAR polynucleotides are delivered to the engineered cell by any viral vector as disclosed herein.

In one embodiment, to achieve enhanced safety profile or therapeutic index, the any of the engineered cells disclosed herein be constructed as a transient RNA-modified "biodegradable" version or derivatives, or a combination thereof. The RNA-modified CARs of the present disclosure may be electroporated into T cells or NK cells. The expression of the compound CAR may be gradually diminished over few days.

In some embodiments of the present disclosure, any of the engineered cells disclosed herein may be constructed in a transponson system (also called a "Sleeping Beauty"), which integrates the CAR DNA into the host genome without a viral vector.

Methods of Generating an Engineered Cell Having Multiple CAR Units

In another embodiment, the present disclosure provides a method making an engineered cell having at least two CAR units.

In some embodiments, multiple units of CAR are expressed in a T or NK cell using bicistronic or multicistronic expression vectors. There are several strategies which can be employed to construct bicistronic or multicistronic vectors including, but not limited to, (1) multiple promoters fused to the CARs' open reading frames; (2) insertion of splicing signals between units of CAR; fusion of CARs whose expressions are driven by a single promoter; (3) insertion of proteolytic cleavage sites between units of CAR (self-cleavage peptide); and (iv) insertion of internal ribosomal entry sites (IRESs).

In a preferred embodiment, multiple CAR units are expressed in a single open reading frame (ORF), thereby creating a single polypeptide having multiple CAR units. In this embodiment, an amino acid sequence or linker containing a high efficiency cleavage site is disposed between each CAR unit.

As used herein, high cleavage efficiency is defined as more than 50%, more than 70%, more than 80%, or more than 90% of the translated protein is cleaved. Cleavage efficiency may be measured by Western Blot analysis, as described by Kim 2011.

Furthermore, in a preferred embodiment, there are equal amounts of cleavage product, as shown on a Western Blot analysis.

Examples of high efficiency cleavage sites include porcine teschovirus-1 2A (P2A), FMDV 2A (abbreviated herein as F2A); equine rhinitis A virus (ERAV) 2A (E2A); and Thoseaasigna virus 2A (T2A), cytoplasmic polyhedrosis virus 2A (BmCPV2A) and flacherie Virus 2A (BmIFV2A), or a combination thereof. In a preferred embodiment, the high efficiency cleavage site is P2A. High efficiency cleavage sites are described in Kim J H, Lee S-R, Li L-H, Park H-J, Park J-H, Lee K Y, et al. (2011) High Cleavage Efficiency of a 2A Peptide Derived from Porcine Teschovirus-1 in Human Cell Lines, Zebrafish and Mice. PLoS ONE 6(4): e18556, the contents of which are incorporated herein by reference.

In embodiments wherein multiple CAR units are expressed in a single open reading frame (ORF), expression is under the control of a strong promoter. Examples of strong promoters include the SFFV promoter, and derivatives thereof.

Engineered Cell Having CAR Polypeptide and Enhancer

In another embodiment, the present disclosure provides a method making an engineered cell that expresses at least one CAR unit and an enhancer.

In some embodiments, at least one CAR unit and enhancer is expressed in a T or NK cell using bicistronic or multicistronic expression vectors. There are several strategies which can be employed to construct bicistronic or multicistronic vectors including, but not limited to, (1) multiple promoters fused to the CARs' open reading frames; (2) insertion of splicing signals between units of CAR; fusion of CARs whose expressions are driven by a single promoter; (3) insertion of proteolytic cleavage sites between units of CAR (self-cleavage peptide); and (4) insertion of internal ribosomal entry sites (IRESs).

In a preferred embodiment, at least one CAR unit and an enhancer are expressed in a single open reading frame (ORF), thereby creating a single polypeptide having at least one CAR unit and an enhancer. In this embodiment, an amino acid sequence or linker containing a high efficiency cleavage site is disposed between each CAR unit and between a CAR unit and enhancer. In this embodiment, the ORF is under the control of a strong promoter. Examples of strong promoters include the SFFV promoter, and derivatives thereof.

Furthermore, in a preferred embodiment, there are equal amounts of cleavage product, as shown on a Western Blot analysis.

Methods of Treatment Using the Compositions Disclosed Herein

In another embodiment, the present disclosure provides a method of targeting CD45 for conditioning prior to allogenic transplantation in cancer treatment. CD45 is also known as leukocyte common antigen (LCA) and is a tyrosine phosphatase expressed on virtually all cells of hematopoietic origin except erythrocytes and platelets. Most hematologic malignancies express CD45. For instance, 85% to 90% acute lymphoid and myeloid leukemias express CD45. CD45 is not found in non-hematopoietic origin. In addition, CD45 is expressed at a high density of an average copy number of approximately 200,000 molecules per cells on malignant cells and leukocytes. CD45 presents an ideal target for a variety of hematologic malignancies. However, CAR T and NK cells also express CD45. Without inactivation of endogenous CD45, CAR T or NK cells armed with CARs targeting CD45 may result in self-killing.

The association of CD45 with TCR complexes is essential in regulation of T-cell activation in response to antigen. The inability of CD45-deficient T cells to present antigen is due to reduced signaling through the T cell receptors (TCRs). TCRs are cell surface receptors that play an essential role in the activation of T cells in response to the presentation of antigen. The TCR is generally made from two chains, alpha and beta, which are associated with the transducing subunits, the CD3, to form the T-cell receptor complex present on the cell surface.

It was surprisingly found that multiple CARs (Compound CARs, cCAR) of the present disclosure combat a key mechanism by which cancer cells resist CAR activity, i.e., the downregulation or heterogeneous expression of the target antigen from the cancer cell surface. This mechanism allows the cancer cell to "hide" from the CAR therapy, a phenomenon referred to as 'antigen escape'. The present disclosure pre-empts cancer antigen escape by recognizing a combination of two or more antigens to rapidly eliminate the tumor.

The disclosure provides a method of simultaneous targeting of multi-antigens using a cCAR resulting in improved tumor control by minimizing the possibility of tumor selection on the basis of target antigen loss or down-regulation.

The disclosed disclosure includes compound (multiple or compound) cCAR in a T or NK cell targeting different or same surface antigens present in tumor cells. The compound chimeric antigen receptors of the present disclosure comprise at least multiple chimeric receptor constructs linked by a linker and target of the same or different antigens. For example, each of the CAR construct present in the compound CAR (cCAR) construct includes an antigen recognition domain, an extracellular domain, a transmembrane domain and/or a cytoplasmic domain. The extracellular domain and transmembrane domain can be derived from any desired source for such domains. The multiple CAR constructs are linked by a linker. The expression of the compound CAR construct is driven by a promoter. The linker may be a peptide or a part of a protein, which is self-cleaved after a protein or peptide is generated (also called as a self-cleaving peptide).

In one embodiments, the compound CARs of the present disclosure target Myelodysplastic Syndrome and acute myeloid leukemia (AML) populations. Myelodysplastic Syndrome (MDS) remains an incurable hematopoietic stem cell malignancy that occurs most frequently among the elderly, with about 14,000 new cases each year in the USA. About 30-40% of MDS cases progress to AML. The incidence of MDS continues to increase as our population ages. Although MDS and AML have been studied intensely, no satisfactory treatments have been developed.

The compositions and methods of this disclosure can be used to generate a population of T lymphocyte or NK cells that deliver both primary and co-stimulatory signals for use in immunotherapy in the treatment of cancer, in particular, the treatment of lung cancer, melanoma, breast cancer, prostate cancer, colon cancer, renal cell carcinoma, ovarian cancer, brain cancer, sarcoma, leukemia and lymphoma.

Immunotherapeutics generally rely on the use of immune effector cells and molecules to target and destroy cancer cells. The effector may be a lymphocyte carrying a surface molecule that interacts, either directly or indirectly, with a tumor cell target. Various effector cells include cytotoxic T cells, NK cells, and NK-92 cells. The compositions and methods described in the present disclosure may be utilized in conjunction with other types of therapy for cancer, such as chemotherapy, surgery, radiation, gene therapy, and so forth. The compositions and methods described in the present disclosure may be utilized in other disease conditions that rely on immune responses such as inflammation, immune diseases, and infectious diseases.

In some embodiments, the compound CAR of the present disclosure may act as a bridge to bone marrow transplant, by achieving complete remission for patients who have minimal residual disease and are no longer responding to chemotherapy. In other embodiments, the compound CAR eliminates leukemic cells followed by bone marrow stem cell rescue to support leukopenia.

In some embodiments, the compound CAR of the present disclosure can combat a key mechanism by which cancer cells resist CAR activity by the down-regulation of the target antigen. In another embodiment, the invented compound CAR can also combat the heterogeneity of cancer cells, which creates significant challenges in a regular CAR T/NK cell therapy. In a further embodiment, the disclosed compound CAR is designed that the first CAR targets the bulky tumor population and another eradicates cancer or leukemic stem cells to avoid cancer relapses.

In one embodiment, the present disclosure provides a method of destroying cells having a CD33 antigen or a CD123 antigen, or both by contacting said cells with an engineered cell having at least one of chimeric antigen receptor polypeptide having a CD33 antigen recognition domain and chimeric antigen receptor polypeptide having a CD23 antigen recognition domain. The engineered cell may be a T or NK cell.

Cells having at least one of the CD33 antigen and the CD123 antigen include acute myeloid leukemia, precursor acute lymphoblastic leukemia, chronic myeloproliferative neoplasms, chronic myeloid leukemia, myelodysplasia syndromes, blastic plasmocytoid dendritic neoplasms (BPDCN), Hodgkin's lymphoma, mastocytosis, and hairy cell leukemia cells.

In another embodiment, the present disclosure provides a method of providing myeloblative conditioning regimens for hematopoietic stem cell transplantation. In this embodiment, a T or NK engineered cell having a CD33 unit and a CD123 unit is administered to a patient in need thereof.

In further embodiments, the present disclosure provides a method of eradicating or killing leukemic stem cells (LSCs) or bulk leukemic cells expressing CD123 or CD33, or both. In this embodiment, a T or NK engineered cell having a CD33 unit and a CD123 unit is administered to a patient in need thereof.

In further embodiments, the compound CAR in a T or NK cell may be used to eradicate or kill CD34+CD38− leukemic stem cells or bulk leukemic cells expressing CD123 or CD33 or both.

In some embodiments, a compound CAR targets cells expressing CD19 or CD20 antigens or both. In another embodiment, a compound CAR targets cells expressing CD19 or CD22 antigens or both. The targeted cells may be cancer cells, such as, without limiting, B-cell lymphomas or leukemias. In further embodiments, the target antigens can include at least one of this group, but not limited to, ROR1, PSMA, MAGE A3, Glycolipid, glypican 3, F77, GD-2, WT1, CEA, HER-2/neu, MAGE-3, MAGE-4, MAGE-5, MAGE-6, alpha-fetoprotein, CA 19-9, CA 72-4, NY-ESO, FAP, ErbB, c-Met, MART-1, CD30, MUC1, MUC2, MUC3, MUC4, MUC5, EGFRvIII, immunoglobin kappa and lambda, CD38, CD52, CD3, CD4, CD8, CD5, CD7, CD2, CD45, and CD138. The target antigens can also include viral or fungal antigens, such as E6 and E7 from the human papillomavirus (HPV) or EBV (Epstein Barr virus) antigens.

In some embodiments, the compound CAR engineered cells target cells having cell surface CD19 antigen or cell surface CD123 antigen or both. The targeted cells are cancer cells, such as, without limiting, B-cell lymphomas or leukemias.

Clinical trials of CD19 CAR T cell therapy have shown that 80-94% of patients with B-ALL achieve complete remission, but a substantial proportion of patients eventually relapse. The prevalence of CD123 expression in B-ALL is high, and can be used as a CAR target for B-ALL.

In some embodiments, the compound CAR targets cells expressing CD19 or CD123 antigen or both. Without wishing to be bound by theory, it is believed that CD19 and/or CD123 compound CAR engineered cells offset tumor escape due to the loss of CD19 or CD123 antigen or prevent B-ALL or other type B-cell lymphoma/leukemia relapse.

In some embodiments, the compound CAR targets cells expressing CD19 or BAFFR antigen or both. Without wishing to be bound by theory, it is believed that CD19 and/or BAFFR compound CAR engineered cells offset tumor escape due to the loss of CD19 or BAFFR antigen or prevent B-ALL or other type B-cell lymphoma/leukemia relapse.

In further embodiments, the CD19 and/or CD20 compound CAR engineered cells target cells having cell surface CD19 antigens and/or CD20 cell surface antigens. In another embodiment, the targeted cells are malignant B cell lymphoma/leukemia such as, without limiting, B-ALL, high grade B cell lymphoma, low grade B-cell lymphoma, diffuse large B cell lymphoma, Burkett lymphoma, mantle cell lymphoma, CLL, marginal zone B cell lymphoma and follicular lymphoma.

Without wishing to be bound by theory, it is believed that the CD19 and/or CD20 CAR engineered cells provide an effective safeguard against antigen escape and prevent disease relapse in adoptive T/NK-cell therapy for B-cell malignancies.

CAR target cells having at least one of the antigens CD19, CD20, CD22, BAFF, and CD123, include precursor acute lymphoblastic leukemia, B-cell lymphoma/leukemia, chronic lymphocytic leukemia/lymphoma, mantle lymphoma, follicular lymphoma, marginal zone B cell lymphoma, diffuse large B cell lymphoma, Burkett lymphoma, blastic plasmocytoid dendritic neoplasms (BPDCN), Hodgkin's lymphoma, and hairy cell leukemia cells.

In one embodiment, the engineered cell includes a first chimeric antigen receptor polypeptide having a CD19 antigen recognition domain and second chimeric antigen receptor polypeptide having a CD22 antigen recognition domain. In one embodiment, this engineered cell includes a polypeptide of SEQ ID NO. 64 and corresponding polynucleotide of SEQ ID NO. 63.

In one embodiment, the engineered cell includes a first chimeric antigen receptor polypeptide having a CD19 antigen recognition domain and second chimeric antigen receptor polypeptide having a CD20 antigen recognition domain. In one embodiment, this engineered cell includes a polypeptide of SEQ ID NO. 66 and corresponding polynucleotide of SEQ ID NO. 65.

In one embodiment, the engineered cell includes a first chimeric antigen receptor polypeptide having a CD19 antigen recognition domain and second chimeric antigen receptor polypeptide having a CD123 antigen recognition domain. In one embodiment, this engineered cell includes a polypeptide of SEQ ID NO. 68 and corresponding polynucleotide of SEQ ID NO. 67.

Multiple myeloma is an incurable disease exhibiting uncontrollable proliferation of plasma cells in the bone marrow. CS1 and BCMA are widely expressed on myeloma cells, but is not expressed in hematopoietic stem/progenitor cells. Therefore, BCMA and CS1 are ideal targets for CAR T/NK cell therapy.

In further embodiments, the present disclosure provides compound CAR engineered cell having a CS1 (SLAM7) antigen recognition domain and/or an antigen recognition domain that targets B-cell maturation antigens (BCMA). In another embodiment, the targeted cells are malignant plasma cells, such as, but not limited to, multiple myeloma.

Without wishing to be bound by theory, it is believed that a compound CAR engineered cell having at least one of CS1 and BCMA antigen recognition domain enhances functionality against multiple myeloma and offset antigen escape.

In some embodiments, a CAR targets cells expressing multiple antigens including, but not limited to, CS1, BCMA, CD267, BAFF-R, CD38, CD138, CD52, CD19, TACI, CD20, interleukin 6 receptor, and NY-ESO-1 antigens. In another embodiment, the targeted cells are plasma cells, B-cells, malignant plasma cells such as, without limiting, multiple myeloma.

In some embodiments, the compound CAR targets cells expressing multiple antigens including, but not limited to, CS1, BCMA, CD267, BAFF-R, CD38, CD138, CD52, CD19, TACI, CD20, interleukin 6 receptor, and NY-ESO-1 antigens. In another embodiment, the targeted cells are malignant plasma cells such as, without limiting, multiple myeloma.

In some embodiments, the compound CAR targets cells expressing multiple antigens including but not limited to, alpha fetoprotein (AFP) and Glypican-3 (GPC3). In another embodiment, the targeting cells are hepatocellular carcinoma, fibrolamellar carcinoma, hepatoblastoma, undifferentiated embryonal sarcoma and mesenchymal hamartoma of liver, lung-squamous cell carcinoma, testicular nonseminomatous germ cell tumors, liposarcoma, ovarian and extragonadal yolk sac tumors, ovarian choriocarcinoma, teratomas, ovarian clear cell carcinoma, and placental site trophoblastic tumor.

Without wishing to be bound by theory, the present disclosure provides compound CAR engineered T cells or NK cells that target different or the same antigens offset tumor escape and provides simultaneous targeting of tumor cells.

The T or NK host cells comprising compound CAR disclosed herein is embodied in the present disclosure. The nucleotide and polypeptide constructs, sequences, host cells, and vectors of the compound CAR are considered to be part of the present disclosure and is embodied herein.

In some embodiments, the compound CAR engineered cell is administered in combination with any chemotherapy agents currently being developed or available in the market. In some embodiments, the compound CAR engineered cell is administered as a first line treatment for diseases including, but not limited to, hematologic malignancies, cancers, non-hematologic malignances, inflammatory diseases, infectious diseases such as HIV and HTLV and others. In one embodiment, T cells expressing the compound CAR engineered cells are co-administered with NK cells expressing the same or different compound CAR as an adaptive immunotherapy. Compound CAR NK cells provide rapid, innate activity targeting cells while compound T cells provide relative long-lasting adaptive immune activity.

In one embodiment, the compound CAR engineered cells are administered as a bridge to bone marrow stem transplantation for mammals, e.g. patients who are resistant to chemotherapies and are not qualified for bone marrow stem cell transplantation.

In some embodiments, the compound CAR co-expresses a transgene and releases a transgenic product, such as IL-12 in the targeted tumor lesion and further modulates the tumor microenvironment.

In one embodiment, compound CAR engineered cells are administered to a mammal for bone marrow myeloid ablation as a part of the treatment to a disease.

In a specific embodiment, the cells expressing a compound CAR can be T cells or NK cells, administered to a mammal, e.g. human. The presented disclosure includes a method of treating a mammal having a disorder or disease by administration of a compound CAR. The targeted cells may be cancer cells such as, or cells affected by any other disease condition, such as infectious diseases, inflammation, and autoimmune disorders.

The present disclosure is intended to include the use of fragments, mutants, or variants (e.g., modified forms) of the compound CAR or antigens that retain the ability to induce stimulation and proliferation of T/NK cells. A "form of the protein" is intended to mean a protein that shares a significant homology with at least one CAR or antigen and is capable of effecting stimulation and proliferation of T/NK cells. The terms "biologically active" or "biologically active form of the protein," as used herein, are meant to include forms of the proteins or variants that are capable of effecting anti-tumor activity of the cells.

The compositions and methods of this disclosure can be used to generate a population of T/NK cells that deliver both primary and co-stimulatory signals for use in immunotherapy in the treatment of cancer, in particular the treatment of lung cancer, melanoma, breast cancer, prostate cancer, colon cancer, renal cell carcinoma, ovarian cancer, neuroblastoma, rhabdomyosarcoma, leukemia and lymphoma. The compositions and methods described in the present disclosure may be utilized in conjunction with other types of therapy for cancer, such as chemotherapy, surgery, radiation, gene therapy, and so forth.

1) In some embodiments, the disclosure provides a method of depleting B cells, immature B cells, memory B cells, plasmablasts, long lived plasma cells, or plasma cells in patients with an autoimmune disease by administering to patients CAR or compound CAR T cells or NK cells. CAR targeted cells are 13 or plasma cells expressing one or two or all of the antigens, BCMA, TACI and BAFF-R. The autoimmune diseases include systemic scleroderma, multiple sclerosis, psoriasis, dermatitis, inflammatory bowel diseases (such as Crohn's disease and ulcerative colitis), systemic lupus erythematosus, vasculitis, rheumatoid arthritis, Sjorgen's syndrome, polymyositis, pulmonary alveolar proteinosis, granulomatosis and vasculitis, Addison's disease, antigen-antibody complex mediated diseases, and anti-glomerular basement membrane disease.

Multiple extracellular cell markers are now being studied for value as tumor-associated antigens and thus potential targets for CAR T/NK cell therapy. However, expression of these antigens on healthy tissue leading to on-target, off-tumor adverse events remains a major safety concern in addition to off-target toxicities. Furthermore, a major limitation of CAR T/NK cell therapy is in the possibility of selecting for antigen escape variants when targeting molecules non-essential to tumorigenesis. Thus, malignant cells that persist with little or no expression of the target antigens may evade CAR T/NK cells, despite their high-affinity action.

In accordance with the present disclosure, natural killer (NK) cells represent alternative cytotoxic effectors for CAR driven killing. Unlike T-cells, NK cells do not need pre-activation and constitutively exhibit cytolytic functions. Further expression of cCARs in NK cells allow NK cells to effectively kill cancers, particularly cancer cells that are resistant to NK cell treatment.

Further, NK cells are known to mediate anti-cancer effects without the risk of inducing graft-versus-host disease (GvHD).

Studies have shown an aberrant overexpression of CD123 on CD34+CD38− AML cells, while the normal bone marrow counterpart CD34+CD38− does not express CD123

(Jordan, Upchurch et al. 2000). This population of CD123+, CD34+CD38− has been considered as LSCs as these cells are able to initiate and maintain the leukemic process in immunodeficient mice.

The number of CD34+/CD38−/CD123+ LSCs can be used to predict the clinical outcome for AML patients. The CD34+/CD38−/CD123+ cells, greater than 15% in AML patients, are associated with a lack of complete remission and unfavorable cytogenetic profiles. In addition, the presence of more than 1% of CD34+/CD38−/CD123+ cells could also have a negative impact on disease-free survival and overall survival.

At the present, therapies for MDS and AML have focused on the leukemic blast cells because they are very abundant and clearly represent the most immediate problem for patients. Importantly, leukemic stem cells (LSCs) are quite different from most of the other leukemia cells ("blast" cells), and they constitute a rare subpopulation. While killing blast cells can provide short-term relief, LSCs, if not destroyed, will always re-grow, causing the patient to relapse. It is imperative that LSCs be destroyed in order to achieve durable cures for MDS disease. Unfortunately, standard drug regimens are not effective against MDS or AML LSCs. Therefore, it is critical to develop of new therapies that can specifically target both the leukemic stem cell population and the bulky leukemic population. The compound CAR disclosed in the present disclosure target both of these populations and is embodied herein.

In accordance to the present disclosure, it was surprisingly found that NK cells provide an off-the-shelf product that may be used as an allogeneic product for treatment. Thus, according to the present disclosure, cCAR cell therapy needs to be performed on a patient-specific basis as required by the current state of art. The applicants of the present disclosure have discovered a novel immunotherapy, where the patient's lymphocytes or tumor infiltrated lymphocytes need not be isolated for an effective CAR cell based therapy.

Allogeneic or autologous NK cells are expected to induce a rapid immune response but disappear relatively rapidly from the circulation due to their limited lifespan. Thus, applicants surprisingly discovered that there is reduced concern of persisting side effects using cCAR cell based therapy.

According to one aspect of the present disclosure, NK cells can be expanded and transfected with cCAR in accordance to the present disclosure. NK cells can be derived from cord blood, peripheral blood, iPS cells and embryonic stem cells. According to one aspect of the present disclosure, NK-92 cells may be expanded and transfected with cCAR. NK-92 is a continuously growing cell line that has features and characteristics of natural killer (NK) cells. NK-92 cell line is IL-2 dependent and has been proven to be safe and feasible. cCAR expressing NK-92 cells can be expanded in the serum free-medium with or without co-culturing with feeder cells. A pure population of NK-92 carrying the cCAR of interest may be obtained by sorting.

Identification of appropriate surface target antigens is a prerequisite for developing CAR T/NK cells in adaptive immune therapy.

In one aspect of the present disclosure, CD123 antigen is one of the targets for cCAR therapy. CD123, the alpha chain of the interleukin 3 receptor, is overexpressed on a variety of hematologic malignancies, including acute myeloid leukemia (AML), B-cell acute lymphoblastic leukemia (B-ALL), hairy cell leukemia, and blastic plasmocytoid dendritic neoplasms. CD123 is absent or minimally expressed on normal hematopoietic stem cells. More importantly, CD123 is expressed on a subset of leukemic cells related to leukemic stem cells (LSCs), the ablation of which is essential in preventing disease refractoriness and relapse.

In one aspect of the present disclosure, CD33 antigen is one of the targets for cCAR therapy. CD33 is a transmembrane receptor expressed on 90% of malignant cells in acute myeloid leukemia. Thus, according to the present disclosure, CD123 and CD33 target antigens are particularly attractive from a safety standpoint.

In accordance with the present disclosure, the compound CD33CD123 CARs may be highly effective for therapeutic treatment of chronic myeloid leukemia (CML) population. In chronic myeloid leukemia (CML), there is a rare subset of cells that are CD34+CD38-. This population is considered as comprised of LSCs. Increased number of LSCs is associated with the progression of the disease. A small-molecule Bcr-Abl tyrosine kinase inhibitor (TKI) is shown to significantly improve the overall survival in CP-CML patients. However, LSCs are thought to be resistant to TKI therapy. A novel therapy targeting CML resistant LSCs is urgently needed for treatment of CML and the novel therapy is embodied in the compound CD33CD123 CAR disclosed in the present disclosure. CD123 expression is high in the CD34+CD38-population. In accordance with the present disclosure, the compound CD33CD123 CARs is highly effective for therapeutic treatment of this population.

In one embodiment of the present disclosure, leukemic cells expressing both CD123 and CD33 in the cCAR are used as a therapeutic treatment. CD33 is expressed on cells of myeloid lineage, myeloid leukemic blasts, and mature monocytes but not normal pluripotent hematopoietic stem cells. CD33 is widely expressed in leukemic cells in CML, myeloproliferative neoplasms, and MDS.

Since a significant number of patients with acute myeloid leukemia (AML) are refractory to standard chemotherapy regimens or experience disease relapse following treatment (Burnett 2012), the development of CAR T cell immunotherapy for AML has the potential to address a great clinical need. In the majority of these patients, leukemic cells express both CD123 and CD33, giving broad clinical applicability to the compound CD33CD123 CAR disclosed herein. Thus, the present disclosure discloses a novel multiple cCAR T/NK cell construct comprising multiple CARs targeting multiple leukemia-associated antigens, thereby offsetting antigen escape mechanism, targeting leukemia cells, including leukemic stem cells, by synergistic effects of co-stimulatory domain activation, thereby providing a more potent, safe and effective therapy.

The present disclosure further discloses a compound CAR construct with enhanced potency of anti-tumor activity against cells co-expressing target antigens, and yet retains sensitivity to tumor cells only expressing one antigen. In addition, each CAR of the compound CAR includes one or two co-stimulatory domains and exhibits potent killing capability in the presence of the specific target.

In pre-clinical studies on dual specificity, trans-signaling CARs targeting solid tumors including breast cancer and epithelial ovarian cancer, a CD3 intracellular signaling domain, is separated from co-stimulatory domains from second generation of CARs. In other words, one CAR contains the first generation of CAR without any co-stimulatory domain, and another lacks a CD3 zeta intracellular domain. Therefore, the presence of both target antigens is required for T cell activation and potent killing. Thus, they were proposed as a way to decrease off-tumor toxicity caused by healthy tissue expression of one of the two target antigens, increasing target specificity, but at the expense of sensitivity. In one embodiment, the compound CAR is a compound CD123CD19 CAR. It has been shown that more than 90% of B-ALLs express CD123 in a subset of population. Like AML and MDS, it has been considered that a rare LSC population exists in B-ALL. Therefore, targeting both leukemic stem cell and bulky leukemic populations in accordance with the present disclosure, can be applied to B-ALLs. CD123 and CD19 surface antigens expressed in the B-ALLs may be targets as CD19 is widely expressed in different stages of B-cell lymphoid populations, in accordance with the present disclosure.

Multiple myeloma (MM) is the second most common hematologic malignancy in the US and is derived from clonal plasma cells accumulated in the bone marrow or extramedullary sites. MM is an incurable disease with a median survival of approximately 4.5 years. Anti-Myeloma CARs in Pre-clinical Development have been developed and CAR targets include CD38, CS1, and B cell maturation Antigen (BCMA). However, heterogeneity of surface antigen expression commonly occurs in malignant plasma cells, which makes it a difficult target for CARs. Malignant plasma cells also express low levels of CD19. Previously it has been shown that myeloma stem cells also express some B-cell markers including CD19. Targeting this population could be effective in the treatment of myeloma in conjunction with standard and other myeloma CAR therapies.

Multiple myeloma (MM) is a haematological malignancy with a clonal expansion of plasma cells. Despite important advances in the treatment, myeloma remains an incurable disease; thus novel therapeutic approaches are urgently needed.

CS1 (also called as CD319 or SLAMF7) is a protein encoded by the SLAMF7 gene. The surface antigen CS1 is a robust marker for normal plasma cells and myeloma cells (malignant plasma cells).

Tumor necrosis factor receptor superfamily, member 17 (TNFRSF17), also referred to as B-cell maturation antigen (BCMA) or CD269 is almost exclusively expressed at the terminal stages of plasma cells and malignant plasma cells. Its expression is absent other tissues, indicating the potential as a target for CAR T or NK cells.

Malignant plasma cells display variable degrees of antigenic heterogeneity for CD269 and CS1. A single CAR unit product targeting either CD269 or CS1 could target the majority of the cells in a bulk tumor resulting in an initial robust anti-tumor response. Subsequently residual rare non-targeted cells are expanded and cause a disease relapse. While multiple myeloma is particularly heterogeneous, this phenomena could certainty apply to other leukemias or tumors. A recent clinical trial at NIH using BCMA CAR T cells showed a promising result with a complete response in some patients with multiple myeloma. However, these patients relapsed after 17 weeks, which may be due to the antigen escape. The antigen escape is also seen in CD19 CAR and NY-ESO1 CAR T cell treatments. Thus, there is an urgent need for more effective CAR T cell treatment in order to prevent the relapse.

In one aspect of the present disclosure, BCMA and CS1 are the targets for BCMACS1 CAR therapy.

In some embodiments, a compound CAR targets cells expressing BCMA or CS1 antigens or both. The targeted cells may be cancer cells, such as, without limiting, lymphomas, or leukemias or plasma cell neoplasms. In further embodiments, plasma cell neoplasms is selected from plasma cell leukemia, multiple myeloma, plasmacytoma, heavy chain diseases, amyloidosis, waldestrom's macroglobulinema, heavy chain diseases, solitary bone plasmacytoma, monoclonal gammopathy of undetermined significance (MGUS) and smoldering multiple myeloma.

In some embodiments, the present disclosure provides a compound CAR polypeptide engineered cell that targets cells expressing BCMA or CD19 antigens or both. The targeted cells may be cancer cells, such as, but not limited to, lymphomas, or leukemias or plasma cell neoplasms. In further embodiments, plasma cell neoplasms are selected from plasma cell leukemia, multiple myeloma, plasmacytoma, heavy chain diseases, amyloidosis, waldestrom's macroglobulinema, heavy chain diseases, solitary bone plasmacytoma, monoclonal gammopathy of undetermined significance (MGUS) and smoldering multiple myeloma.

BAFF (B-cell-activation factor) and APRIL (a proliferation-induced ligand) are two TNF homologs that bind specifically TACI (also called as TNFRSF1 3B or CD267) and BCMA with high affinity. BAFF (also known as BLyS) binds BAFF-R and functionally involves in the enhancement of survival and proliferation of later stage of B cells. BAFF has been shown to involve some autoimmune disorders. APRIL plays an important role in the enhancement of antibody class switching. Both BAFF and APRIL have been implicated as growth and survival factors for malignant plasma cells.

Ligand-receptor interactions in the malignant plasma cells or normal plasma cells are described in FIGS. 77 and 79.

In some embodiments, the present disclosure provides a compound CAR engineered cell that targets cells expressing TACI or CS1 antigens or both. In another embodiment, a compound CAR engineered cell that targets cells expressing TACI or CS1 antigens or both. The targeted cells may be cancer cells, such as, without limiting, lymphomas, or leukemias or plasma cell neoplasms. In further embodiments, plasma cell neoplasms is selected from plasma cell leukemia, multiple myeloma, plasmacytoma, heavy chain diseases, amyloidosis, waldestrom's macroglobulinema, heavy chain diseases, solitary bone plasmacytoma, monoclonal gammopathy of undetermined significance (MGUS) and smoldering multiple myeloma. The target cells may also be one or two or multiple different cell types of B cells, immature B cells, naïve B cells, centroblasts, centrocytes, memory B cells, plasmablasts, long lived plasma cells, plasma cells. These cells involve autoimmune diseases include systemic scleroderma, multiple sclerosis, psoriasis, dermatitis, inflammatory bowel diseases (such as Crohn's disease and ulcerative colitis), systemic lupus erythematosus, vasculitis, rheumatoid arthritis, Sjorgen's syndrome, polymyositis, granulomatosis and vasculitis, Addison's disease, antigen-antibody complex mediated diseases, and anti-glomerular basement membrane disease.

In some embodiments, the present disclosure provides a compound CAR engineered cell that targets cells expressing BAFF-R or CS1 antigens or both. In another embodiment, a compound CAR engineered cell that targets cells expressing BAFF-R or CS1 antigens or both. The targeted cells may be cancer cells, such as, without limiting, lymphomas, or leukemias or plasma cell neoplasms. In further embodiments, plasma cell neoplasms is selected from plasma cell leukemia, multiple myeloma, plasmacytoma, heavy chain diseases, amyloidosis, waldestrom's macroglobulinema, heavy chain diseases, solitary bone plasmacytoma, monoclonal gammopathy of undetermined significance (MGUS) and smoldering multiple myeloma.

Autoimmune disorders such as lupus erythematosus (SLE), pemphigus vulgaris and multiple sclerosis (MS) cause significant morbidity and disability. These diseases respond poorly to current therapies and frequent relapse during disease course is noted. B and plasma cells play a critical role in the pathogenesis of autoimmune disorders as they are the sources of autoantibody production. B and plasma cells may contribute to disease progression and relapse through antigen presentation, cytokine secretion, or antibody production. Deletion of B cells or plasma cells or both using CAR T/NK cell approaches can be a beneficial therapy.

An organ transplant represents a new life for a person and organs that can be transplanted could include the kidneys, heart, lungs, pancreas and intestine. However, many patients are unable to receive a potentially life-saving organ because of pre-existing or developing donor-specific antibody against the donor's antigens such human leukocyte antigens (HLA). Thus, patients may lose the donated organ. Currently there are few treatment options available for antibody mediated rejection, and an enormous unmet need in the field for efficacious treatment of antibody mediated rejection. Deletion of B cells or plasma cells or both using CAR T/NK cell provide a therapy for antibody-mediated rejection.

The disclosed disclosure provides compositions and methods relating to CAR engineered cells that target cells expressing CD19 or CD20 that result in the deletion of B cells but spare long-lived plasma cells in patients with antibody mediated organ rejection or autoimmune disorders including, but not limited to, systemic lupus erythematosus (SLE), rheumatoid arthritis (RA), and pemphigus vulgaris and multiple sclerosis (MS). The deletion of B cells by CAR is beneficial to the reduction of disease activity.

The present disclosure also provides compositions and methods relating to CAR engineered cells that target cells expressing BCMA or BAFF-R, TACI which results in the deletion of plasma cells in patients with antibody mediated organ rejection or autoimmune disorders including, but not limited to, systemic lupus erythematosus (SLE), rheumatoid arthritis (RA), and pemphigus vulgaris and multiple sclerosis (MS). The deletion of plasma cells can contribute to the reduction of disease activity.

In some embodiments, the present disclosure provides compositions and methods relating to CAR engineered cells for CARs depleting mature, memory B cells, and short, long lived plasma cells for treatment of autoimmune disorders and organ antibody-mediated organ rejection. In one embodiment, the present disclosure provides a method for depleting mature, memory B cells, and short, long lived plasma cells using one or more of the following strategies:

1) Depletion of mature, memory B cells and short, long lived plasma cells by a contacting said cells with an CAR engineered cell having a scFv against CD19 or CD20 or CD22;
2) Depletion of short- and long-lived plasma cells by contacting said cells with a CAR engineered cell having a scFv against BCMA or TACI or BAFF-R; or
3) Depletion of short- and long-lived plasma cells by contacting said cells with a CAR engineered cell having an antigen recognition domain including BCMA or TACI or BAFF-R binding domain (BAFF or APRIL);
4) Deletion of mature, memory B cells, and short, long lived plasma cells contacting said cells with a compound CAR engineered cell targeting more than one different antigen to provide a reduction of disease activity for patients with antibody mediated organ rejection or autoimmune disorders.
5) Deletion of mature, memory B cells, and short, long lived plasma cells by contacting a CAR engineered cells that target more than one different antigen selecting from CD19, CD20, CD22, BCMA, TACI, APRIL and BAFF.

In some embodiments, a compound CAR (cCAR) targets cells expressing one or two or all of BAFF-R, BCMA, TACI and CS1 antigens.

In some embodiments, a unit of CAR in a cCAR can comprise: 1) a scFv against either BAFF-R, BCMA, TACI and CS1; 2) a hinge region; 3) co-stimulatory domain (s) and intracellular signaling domain.

In some embodiments, BAFF CAR can be a unit of CAR in a cCAR comprises: 1) BCMA or TACI or BAFF-R binding domain; 2) a hinge region; 3) co-stimulatory domain (s) and intracellular signaling domain.

In some embodiments, APRIL CAR can be a unit of CAR in a cCAR comprises: 1) BCMA or TACI binding domain; 2) a hinge region; 3) co-stimulatory domain (s) and intracellular signaling domain.

In a further embodiment, BCMA or TAC1 or BAFF-R binding domain can be a part of or entire APRIL and BAFF molecules.

In some embodiments, a unit of CAR in a cCAR can comprise: 1) a scFv against BCMA or CS1; 2) a hinge region; 3) co-stimulatory domain (s) and intracellular signaling domain.

In some embodiments, a unit of CAR in a cCAR can comprise: 1) a scFv against BCMA or CD19; 2) a hinge region; 3) co-stimulatory domain (s) and intracellular signaling domain.

In some embodiments, a unit of CAR in a cCAR can comprise: 1) a scFv against BCMA or CD20; 2) a hinge region; 3) co-stimulatory domain (s) and intracellular signaling domain.

In some embodiments, a unit of CAR in a cCAR can comprise: 1) BAFF-R binding domain or a scFv against BCMA; 2) a hinge region; 3) co-stimulatory domain (s) and intracellular signaling domain.

In some embodiments, a unit of CAR in a cCAR can comprise: 1) BAFF-R binding domain or a scFv against CD19; 2) a hinge region; 3) co-stimulatory domain (s) and intracellular signaling domain.

In some embodiments, a unit of CAR in a cCAR can comprise: 1) BAFF-R binding domain or a scFv against CD20; 2) a hinge region; 3) co-stimulatory domain (s) and intracellular signaling domain.

It is unexpected that some myeloma cells are dim (weak) or negative for BCMA. To increase the sensitivity of CAR antigen recognition in myeloma cells, it is critical to target multiple antigens to cure this disease.

TACI, BCMA and BAFF-R are receptors for BAFF. It is also unexpected that some myeloma cells express CD19, TACI or BAFF-R over BCMA.

In some embodiments, the disclosure provides a method of comprising a BAFF CAR targeting a cell expressing at least one of receptors, CD19, BAFF-R, TACI and BCMA to improve therapeutic efficacy and reduce the risk of antigen disease escape.

The affinity for BAFF binding to BCMA is within the micromolar range, which is much lower than that of BAFF-R or TACI in the nanomolar range.

In some embodiments, the disclosure provides a method of generating a compound cCAR comprising BAFF and BCMA CARs to complement some of myeloma cells that cannot be eliminated by a BAFF CAR.

In some embodiments, the disclosure provides a method of generating a compound cCAR comprising CD19, and BCMA CARs to complement some of myeloma cells that cannot be eliminated by a BCMA CAR.

In some embodiments, the disclosure provides a method of generating a compound cCAR comprising CD19, and CS1 CARs to complement some of myeloma cells that cannot be eliminated by a CS1 CAR.

In further embodiments, cCAR can comprise one or two or multiple units of CAR. Each unit CAR could bear same or different hinge region and co-stimulatory domain.

In further embodiments, cCAR can comprise polypeptides two or more CAR polypeptide units. Each unit CAR could bear a different polynucleotide sequence to avoid a homologous recombination.

In some embodiments, targeting more than one different antigen can be achieved by pooled CAR engineered cells, which are generated by at least two separate CAR T or NK cells. As used herein, pooled CAR engineered cells include a population of engineered cells having more than one distinct CAR polypeptide unit. By way of example, pooled engineered cells include a population of engineered cells with a distinct CAR polypeptide and a population of engineered cells with a different and distinct CAR polypeptide. Furthermore, the pooled CAR engineered cells include engineered cells having cCAR polypeptides.

The pooled CAR T or NK cells can be completed by the following steps:
1) Generate at least two separate constructs of CARs targeting different antigens; 2) Transduce individual construct to T or NK cells and expand them ex vivo in a standard medium;
3) Pool different expanded T or NK cells at an appropriate ratio; and
4) Administer pooled CAR T or NK cells to a subject.

In the alternative, the different engineered cells may be individual expanded and independently or sequentially administered.

In further embodiments, the target antigens can include at least one of this group, but not limited to, ROR1, PSMA, MAGE A3, Glycolipid, glypican 3, F77, GD-2, WT1, CEA, HER-2/neu, MAGE-3, MAGE-4, MAGE-5, MAGE-6, alpha-fetoprotein, CA 19-9, CA 72-4, NY-ESO, FAP, ErbB, c-Met, MART-1, CD30, EGFRvIII, immunoglobin kappa and lambda, CD38, CD52, CD3, CD4, CD8, CD5, CD7, CD2, and CD138. The target antigens can also include viral or fungal antigens, such as E6 and E7 from the human papillomavirus (HPV) or EBV (Epstein Barr virus) antigens.

In some embodiments, a cCAR engineered cell targets a cell expressing either CD19 or CD20 antigens or both of them. In another embedment, a cCAR engineered cells target a cell expressing either CD19 or CD22 antigens or both of them. The targeted cells are normal B cells associated with autoimmune disorders or cancer cells such as B-cell lymphomas or leukemias.

Acute graft-versus-host disease (GVHD) remains the most important cause of morbidity and mortality after allogeneic hematopoietic stem cell transplantation. In the effector phase of GVHD, T cell receptor (TCR), a heterodimer of alpha and beta chains, is expressed on the surface of T cells, TCR recognizes some antigens on the HLA molecule on host cells, enhances T cell proliferation, and releases cytotoxic agents that cause the damage on host cells. TCR gene inactivation is efficient at preventing potential graft-versus-host reaction. The inactivation of TCRs can result in the prevention of the TCR recognition of alloantigen and thus GVHD. The role of CD45 on NK cells is quite different from that of T cells. NK cells from CD45-deficient mice have normal cytotoxic activity against the prototypic tumor cell line, Yac-1. In addition, CD45-deficient NK cells proliferate normally and respond to IL-15 and IL-21. Therefore, CD45 disruption or deletion would not affect the NK cell killing and proliferation. The present disclosure includes methods of permanent deletion of CD45 in a T or NK cell with subsequent stable introduction of CD45-specific CARs. As a result, the engineered T cells display the desired properties of redirected specificity for CD45 without causing self-killing and response to presentation of antigen. In a further embodiment, the engineered T cells may have efficacy as an off-the-shelf therapy for treating malignancies or other diseases. The present disclosure relates to a method where T-cells are engineered to allow proliferation when TCR signaling is reduced or lost through the inactivation or deletion of endogenous CD45. The reduction or loss of TCR signaling could result in the prevention of GVHD. In a further embodiment, T cells reducing or losing the TCR signaling by the inactivation of CD45 could be used as an "off the shelf" therapeutic product.

The present disclosure includes methods of modified T or NK cells, which comprises: (a) modifying T or NK cells by inactivating CD45; (b) expanding these modified cells; (c) sorting modified T or NK cells, which do not express CD45; (d) introducing CD45CAR. In embodiments, the CD45CAR gene encodes a chimeric antigen receptor (CAR), wherein the CAR comprises at least one of an antigen recognition domain, a hinge region, a transmembrane domain, and T cell activation domains, and the antigen recognition domain is redirected against CD45 surface antigen present on a cell. The antigen recognition domain includes a monoclonal antibody or a polyclonal antibody directed against CD45 antigen. The antigen recognition domain includes the binding portion or a variable region of a monoclonal or a polyclonal antibody.

The present disclosure includes methods of improving CD45CAR T/NK cell expansion, persistency and anti-tumor activity by co-expressing secretory IL-15/IL-15sushi complexes. In a further embodiment, engineered CD45CAR T/NK cells comprise secretory IL-15/IL-15sushi complexes, which can promote expansion of specific CAR T/NK cells, and promote infiltrate of innate immune cells to the tumor sites resulting in tumor destruction.

The present disclosure provides an alternative strategy in which engineered CD45 CAR T cells receive not only costimulation through the CD28 pathway but also co-express the 4-1BB ligand (CD137L), which provide high therapeutic efficacy.

In some embodiments, the modified T cells are obtained from allogeneic donors and used as an "off-the-shelf product".

Targeting CD45 using CAR T or NK cells may cause self-killing as T and NK cells express this surface antigen. To overcome this drawback, the present disclosure provides engineered cells that are deficient in CD45. As used herein, an engineered cell is deficient for a particular gene when expression of the gene is reduced or eliminated. Reduction or elimination of expression can be accomplished by any genetic method known in the art. In one example, the CD45 gene may be inactivated by using engineered CRISPR/Cas9 system, zinc finger nuclease (ZFNs) and TALE nucleases (TALENs) and meganucleases. The loss of CD45 in T or NK cells is further transduced with CARs targeting neoplasms expressing CD45.

The disclosure includes methods for eliminating or reducing abnormal or malignant cells in bone marrow, blood and organs. In, B and some embodiments, malignant cells expressing CD45 are present in patients with acute leukemia, chronic leukemia T cell lymphomas, myeloid leukemia, Acute lymphoblastic lymphoma or leukemia, primary effusion lymphoma, Reticulohistiocytoma, transient myeloproliferative disorder of Down's syndrome, lymphocyte predominant Hodgkin's lymphoma, myeloid leukemia or sarcoma, dendrocytoma, histiocytic sarcoma, Giant cell tumor of tendon sheath, interdigitating dendritic cell sarcoma, post-transplant lymphoproliferative disorders, etc.

Hematopoietic stem cell transplantation (HSCT) has been widely used for the treatment of hematologic malignancies or non-hematologic diseases. Non-hematologic diseases include genetic disorders and immunodeficiencies and auto-immune disorders. Genetic disorders include, not limited to, sickle cell disease, thalassemia and lysosomal storage diseases. Before stem cell transplant, patients are required to undergo a conditional therapy to deplete hematopoietic stem/progenitor cells in the bone marrow niches to promote the donor stem cell engraftment and proliferation. High doses of chemotherapies and total body irradiation are used for conditional therapies, which cause severe toxicity and long-term complications particularly in non-hematopoietic organs such as severe intestinal mucositis. In addition, conventional conditional therapies could destruct bone marrow niches resulting hematopoietic cell recovery. The safety concerns represent a major obstacle in effort to expand HSCT to a variety of non-hematologic diseases. CD45 is expressed only on hematopoietic cells and targeting CD45 should minimize the toxicity to non-hematopoietic organs.

In some embodiments, CD45CAR cells are used to make space in the bone marrow for bone marrow stem cell transplant by removing hematopoietic cells, at the same time removing leukemic/lymphoma cells or immunologic cells capable of graft rejection.

In some embodiments, CD45CAR engineered cells are used to deplete hematopoietic stem/progenitor cells while the architecture and vasculature of the bone marrow are preserved, in contrast to the disruptive effects of total body irradiation on these tissues. Preservation of the architecture and vasculature of the bone marrow allows faster hematopoietic recovery after transient CD45CAR treatment.

In a further embodiment, CD45CAR cells may be used for pre-treatment of patients before their undergoing a bone marrow transplant to receive stem cells. In a further embodiment, CD45CAR can be used as myeloblative conditioning regimens for hematopoietic stem cell transplantation.

In a preferred embedment, CD45CAR engineered cell therapy is transient for allowing faster recovery of bone marrow and peripheral hematopoietic cells. Transient therapy may be accomplished by using short lived engineered cells or providing an engineered cell having the suicide system as described herein.

In some embodiments, the present disclosure comprises a method of selectively depleting or ablating an endogenous hematopoietic stem/progenitor population, where the endogenous hematopoietic stem/progenitor cells expressing CD45, by contacting said cells with CD45CAR engineered cell that specifically targets CD45 expressing hematopoietic stem/progenitor cells.

In some embodiment, CD45CAR cells are utilized for treating or preventing a residual disease after stem cell transplant and/or chemotherapy.

In some embodiments, the CD45CAR is part of an expressing gene or a cassette. In a preferred embodiment, the expressing gene or the cassette includes an accessory gene or a tag or a part thereof, in addition to the CD45CAR. The accessory gene may be an inducible suicide gene or a part thereof, including, but not limited to, caspase 9 gene, thymidine kinase, cytosine deaminase (CD) or cytochrome P450. The "suicide gene" ablation approach improves safety of the gene therapy and kills cells only when activated by a specific compound or a molecule. In some embodiments, the suicide gene is inducible and is activated using a specific chemical inducer of dimerization (CID).

In some embodiments, the safety switch can include the accessory tags are a c-myc tag, CD20, CD52 (Campath), truncated EGFR gene (EGFRt) or a part or a combination thereof. The accessory tag may be used as a nonimmunogenic selection tool or for tracking markers. In some embodiments, safety switch can include a 24-residue peptide that corresponds to residues 254-277 of the RSV F glycoprotein A2 strain (NSELLSLINDMPITNDQKKLMSNN). In some embodiments, a safety switch can include the amino acid sequence of TNF a bound by monoclonal anti-TNF a drugs. In some embodiments, a safety switch can include an inducible caspase 9 (iCasp9) gene system. A CAR can coexpress an inducible caspase 9 (iCasp9) gene system via P2T or T2A cleavage sequence.

IL-15 and its Receptor in Enhancing CAR T and NK Cell Functions

Recent studies have demonstrated that T cell persistence correlates well with CAR T cell therapeutic efficacy. Recent trials demonstrate that potent and persistent antitumor activity can be generated by an infused small number of CAR T cells indicative that quality rather than quantity of infused products is more important in contributing to the anti-tumor activity. Interleukin (IL)-15 is a cytokine that promotes the development and hemostasis of lymphocytes. Increased levels of IL-15 promote T-cell proliferation and enhance T cell effector response. Data from recent studies have shown that IL-15 is crucial for the generation and maintenance of memory CD8 T-cells, one of the key factors associated with anti-tumor activity. IL-15 binds the IL-15 receptor alpha chain (also called IL-15RA or RA) contributing to IL-15-mediated effects such as T-cell survival, proliferation and memory T cell generation.

IL-15RA binds the βγ complex in the surface of T cells and IL-15 signals by binding with this IL-15RA/βγ complex on the cell surface of T cells and other types of cells.

Transfection of IL-15 alone does not significantly influence T-cell function, transfection of IL-15/1lIL-15RA allows T cells to survive and proliferate autonomously.

The efficacy of administered IL-15 alone may be limited by the availability of free IL-15RA and its short half-life. Administration of soluble IL-15/RA complexes greatly enhanced Il-15 half-life and bioavailability in vivo. Therefore, treatment of mice with this complex, but not with IL-15 alone results in robust proliferation and maintenance of memory CD8 T cells and NK cells. A portion of the extracellular region of IL-15RA called sushi domain (IL-15sushi) is required for its binding of IL-15 (WEI et al., J. Immunol., vol. 167(1), p:277-282, 2001). The IL-15/sushi fusion protein is also called IL-15/IL-15sushi containing the linker is more potent than IL-15 and soluble IL-15RA (IL-15sushi) alone. The combination of IL-15/RA (membrane bound form) or IL-15/sushi (soluble form) can maximize IL-15 activity. The membrane bound form, IL-15/RA would not release of free IL-15 by keeping IL-15 bound to IL-15RA on the surface of transduced cells.

In the present disclosure, it is unexpected to find that the soluble IL-15/IL-15sushi released from transduced cells are able to promote the expansion of transduced cells and their neighbor cells, and further stimulate them against tumor.

The present disclosure provides an engineered cell having both CAR and IL-15/IL-15sushi or IL-15/RA in a single construct. In some embodiments, the disclosure includes methods to generate higher virus titer and use a stronger promoter to drive both CAR and IL-15/RA or IL-15/IL-15sushi.

In some embodiments, the present disclosure provides an engineered cell having: (1) a CAR targeting an antigen including, but not limited to, CD4, CD2, CD3, CD7, CD5, CD45, CD20, CD22, CD19, CD33, CLL-1, CD30, CD30, BAFFR, CD123, CS1, and B-cell mature antigen (BCMA); and (2) IL-15; (3) IL-15RA (membrane bound) or secreting sushi (IL-15/IL-15 sushi) or IL-15/IL-15 sushi ancor. In further embodiments, CAR comprises chimeric antigen receptor, one or more of co-stimulatory endodomains including, but not limited to, CD28, CD2, 4-1BB, 4-1BBL (CD137L), B7-2/CD86, CTLA-4, B7-H1/PD-L1, ICOS, B7-H2, PD-1, B7-H3, PD-L2, B7-H4, CD40 Ligand/TNFSF5, DPPIV/CD26, DAP12 and OX40, and intracellular domain of CD3 zeta chain. In further embodiments, a strong promoter can be, but is not limited to, SFFV. CARs, IL-15/RA or sushi and inducible suicide gene ("safety switch"), or a combination can be assembled on a vector, such as a lentiviral vector, adenoviral vector and retroviral vector or a plasmid. The introduction of "safety switch" could significantly increase safety profile. and limit on-target or off-tumor toxicities of CARs.

In one embodiment, the engineered cell includes a CD2 chimeric antigen receptor polypeptide and IL-15/IL-15sushi (SEQ ID NO.102), and corresponding polynucleotide (SEQ ID NO. 101). Without wishing to be bound by theory, it is believed that co-expression of IL-15/IL-15sushi with a CD2 CAR provides long-term durable remissions in patients by increasing the sensitivity of CAR recognition of target cancer cells or recruiting innate immune cells to cancer cells.

In one embodiment, the engineered cell includes a CD3 chimeric antigen receptor polypeptide and IL-15/IL-15sushi (SEQ ID NO.104), and corresponding polynucleotide (SEQ ID NO. 103). Without wishing to be bound by theory, it is believed that co-expression of IL-15/IL-15sushi with a CD3 CAR provides long-term durable remissions in patients by increasing the sensitivity of CAR recognition of target cancer cells or recruiting innate cells against target cancer cells.

In one embodiment, the engineered cell includes a CD7 chimeric antigen receptor polypeptide and IL-15/IL-15sushi (SEQ ID NO.106), and corresponding polynucleotide (SEQ ID NO. 105). In some embodiments, the present disclosure provides a method of providing long-term durable remission in a cancer patient by administering a CD7 CAR engineered cell that co-expresses IL-15/IL-15sushi to a patient in need thereof. Without wishing to be bound by theory, it is believed that co-expression of IL-15/IL-15sushi with a CD7 CAR provides long-term durable remissions in patients by increasing the sensitivity of CAR recognition of target cancer cells or recruiting innate immune cells to cancer cells.

In one embodiment, the engineered cell includes a CD5 chimeric antigen receptor polypeptide and IL-15/IL-15sushi (SEQ ID NO.107), and corresponding polynucleotide (SEQ ID NO. 108). In some embodiments, the present disclosure provides a method of providing long-term durable remission in a cancer patient by administering a CD5 CAR engineered cell that co-expresses IL-15/IL-15sushi to a patient in need thereof. Without wishing to be bound by theory, it is believed that co-expression of IL-15/IL-15sushi with a CD5 CAR provides long-term durable remissions in patients by increasing the sensitivity of CAR recognition of target cancer cells or recruiting innate immune cells to cancer cells.

CAR Targeting CD4+CD25+ Regulatory T Cells

Regulatory T cells (Tregs), also called suppressor T cells, are a sub-population of T cells which regulate the immune system and maintain tolerance of self-antigens. Tregs constitute about 1-5% of total CD4+ T cells in blood with diverse clinical applications in transplantation, allergy, asthma, infectious diseases, graft versus host disease (GVHD), and autoimmunity. The biomarkers for Tregs are CD4, Foxp3 and CD25. Tregs are considered to be derived from Naïve CD4 cells.

In cancers, Tregs play an important role in suppressing tumor immunity and hindering the body's innate ability to control the growth of cancerous cells.

Tregs expand in patients with cancer and are often enriched in the tumor microenvironment. Tregs cab infiltrate tumors and limit antitumor immunity as well. Depletion of Treg can render mice capable of rejecting tumors that normally grow progressively.

Depletion of Tregs using antibodies targeting CD25 results in partial reduction of Tregs but anti-tumor activity is limited. A high-level of Treg depletion is required for a profound anti-tumor effect. In addition, there is a significant issue concerning specificity, as Tregs share CD25 expression with activated CD4+ and CD8+ lymphocytes as well as activated NK cells. In general, Tregs are very difficult to effectively discern from effector T cells and NK cells, making them difficult to study.

In one embodiment, the engineered cell includes a first chimeric antigen receptor polypeptide having a CD4 antigen recognition domain and second chimeric antigen receptor polypeptide having a CD25 antigen recognition domain. In one embodiment, this engineered cell includes a polypeptide of SEQ ID NO.92 with a CD45 leader sequence and corresponding polynucleotide of SEQ ID NO. 91.

In one embodiment, the engineered cell includes a first chimeric antigen receptor polypeptide having a CD4 antigen recognition domain and second chimeric antigen receptor polypeptide having a CD25 antigen recognition domain. In one embodiment, this engineered cell includes a polypeptide of SEQ ID NO.94 with a CD8a leader sequence and corresponding polynucleotide of SEQ ID NO. 93.

Specific Embodiments for T-Regulatory Cells

T lymphocytes (T cells) are a subtype of white blood cells that play a key role in cell-mediated immunity. T cells are divided into CD4 and CD8 cells. Natural killer cells (NK cells) are a type of cytotoxic cells critical to the innate immunity.

T-regulatory cells (Tregs) are a type of CD4+ cells mediating immune tolerance and suppression and are distinguished from helper T cells. Tregs express CD4, CD25 and Foxp3 (CD4CD25+ regulatory T cells).

Tregs are enriched in the tumor microenvironment and considered to be important for hindering antitumor immune responses and promoting cancer cell tolerance. Increased numbers of infiltrating Tregs in tumors have been associated poor survival in a variety of cancers including hematologic malignancies and solid tumors.

Tregs appear to be preferentially trafficked to the tumor microenvironment and play a critical role of immunosuppression (Ethan M. Shevach et al, Annual Review of Immunology, Vol. 18: 423-449, 2000).

A number of different methods are employed to delete Tregs for cancer treatments by targeting CD25, resulting in a partial reduction of Tregs. However, this could be problematic as: (1) CD25 is also expressed in activated CD4, CD8 and NK cells. CD25 expression can be seen in activated B cells, macrophages, osteoblasts, some thymocytes, some myeloid precursors and some oligodendocytes. (2) a very high-level of Treg depletion is required for efficacy (Xingrui Li et al, Eur. J. Immunol. 2010. 40: 3325-3335).

The CAR design is to redirect patient or donor immune cells against a specific "target" antigen in a major-histocompatibility complex (MHC)—independent manner. The CAR protein construct usually includes a number of modular components or regions integral to function. The module for "target" recognition is the extracellular single-chain variable fragment (scFv). This component is derived from a monoclonal antibody with specific direction against a carefully selected target antigen. A hinge region of appropriate length tandem to the scFv conveys mobility of the scFv region to allow for optimal binding to the target protein. The transmembrane domain region serves as a conduit between the extracellular binding regions and co-activation domains' such as CD28 and/or 4-1BB. The final module includes the CD3 zeta intracellular signaling domain.

The present disclosure provides a method for a novel Treg CAR (also called CD4zetaCD25CAR or C4-25z CAR) construct targeting a cell co-expressing CD4 and CD25. The Treg CAR depletes Tregs specifically while sparing most of cells that do not co-express CD4 and CD25.

In some embodiments, T cell activation could be achieved upon simultaneous engagement of two scFv molecules against CD4 and CD25 in a Treg CAR. In a further embodiment, both T cell activation and co-stimulation signals are provided using two distinct/separate chimeric antigen receptor polypeptides.

In some embodiments, a TregCAR includes (1) a first chimeric antigen receptor polypeptide unit comprising a first signal peptide, a first antigen recognition domain, a first hinge region, a first transmembrane domain, and an intracellular signaling domain; and (2) a second chimeric antigen receptor polypeptide unit comprising a second signal peptide, a second antigen recognition domain, a second hinge region, a second transmembrane domain, and a co-stimulatory domain (s). Both the first chimeric antigen receptor polypeptide unit and the second chimeric engineered polypeptide unit are expressed on a single polypeptide molecule, and wherein an amino acid sequence comprising a high efficiency cleavage site is disposed between the first chimeric antigen receptor polypeptide unit and the second chimeric antigen receptor polypeptide unit.

In some embodiments, the Treg CAR potentiates the lysis activity of a cell co-expressing CD4 and CD25 while minimizing a cell bearing only CD4 or CD25 antigen.

In some embodiments, the nucleotide sequence of the first chimeric antigen receptor polypeptide unit is different from the second chimeric engineered polypeptide unit in order to avoid a homologous recombination.

In some embodiments, the high efficiency cleavage site in Treg CAR is P2A.

In some embodiments, the target of the first antigen recognition domain is either CD4 or CD25 and the target of the second antigen recognition domain is either CD4 or CD25; wherein the first antigen recognition domain is different than the second antigen recognition domain.

In one embodiment, the antigen recognition domain includes the binding portion or variable region of a monoclonal or polyclonal antibody directed against (selective for) the target. In a further embodiment, the target antigen is CD4 or CD25.

In some embodiments, the T or NK cell comprising Treg CARs targeting different or same antigens.

In some embodiments, the T or NK cell comprises Treg CARs targeting Tregs expressing CD4 and CD25 while sparing most of cells, which do not co-express CD4 and CD25.

In some embodiments, the T or NK cell comprises Treg CARs depleting Tregs.

In some embodiments, the present disclosure provides a method of generation of Treg CAR useful for treating or preventing a CD4+CD25+Foxp3+ T regulatory cell (Treg) related disease in a subject is provided. In a further embodiment, the diseases treated with Treg CAR include, but not limiting to, cancers.

In some embodiments, the present disclosure provides a method of generation of Treg CAR useful for treating or preventing a CD4+CD25+Foxp3+ T regulatory cell (Treg) related Cancers including, but not limited, hepatocellular carcinoma, fibrolamellar carcinoma, hepatoblastoma, undifferentiated embryonal sarcoma and mesenchymal hamartoma of liver, lung-squamous cell carcinoma, testicular nonseminomatous germ cell tumors, liposarcoma, ovarian and extragonadal yolk sac tumors, ovarian choriocarcinoma, teratomas, ovarian clear cell carcinoma, placental site trophoblastic tumor, lymphoma and leukemia.

In some embodiments, the present disclosure provides a method of generation of Treg CAR useful for inhibiting the growth of a tumor in a subject is provided.

In some embodiments, the Treg CAR is administered in combination with any chemotherapy agents currently being developed or available in the market. In some embodiments, the Treg CAR is administrated as a first line treatment for diseases including, but not limited to, hematologic malignancies and cancers.

In some embodiments, the cells expressing a Treg CAR are co-administrated with immunomodulatory drugs, such as, but not limited to, CTLA-4 and PD-1/PD-L1 blockades, or cytokines, such as IL-2, IL-15 or IL-15/IL-15sushi or IL-15/IL-15 sushi anchor, IL-15/RA, and IL-12 or inhibitors of colony stimulating factor-1 receptor (CSF1R) for better therapeutic outcomes.

In some embodiments, the cells expressing a Treg CAR are co-administrated with other immunomodulatory drugs or CAR-expressing cells to provide synergistic effects in a subject.

In a specific embodiment, the cells expressing a Treg CAR can be T cells or NK cells, administrated to a mammal, e.g. human.

In some embodiments, the Treg CAR is used in immunotherapy in the treatment of cancers. The cancers may be selected from the group consisting of lung cancer, melanoma, breast cancer, prostate cancer, colon cancer, renal cell carcinoma, ovarian cancer, cervical cancer, head or neck cancer, stomach cancer, liver cancer, neuroblastoma, rhabdomyosarcoma, leukemia and lymphoma. The compositions and methods described in the present disclosure may be utilized in conjunction with other types of therapy for cancer, such as chemotherapy, surgery, radiation, gene therapy, and so forth.

To achieve enhanced safety profile or therapeutic index, the Treg CAR of the present disclosure may be constructed as a transient RNA-modified "biodegradable" version or derivatives, or a combination thereof. The RNA-modified CARs of the present disclosure may be electroporated into T cells or NK cells. The expression of the Treg CAR may be gradually diminished over few days.

A method for treating cancers using Treg CAR in a subject is embodied in the present disclosure. The method comprises:

(1) Obtaining T/NK cells from a subject or donor(s).
(2) Culturing the lymphocytes/T cells or NK cells.
(3) Introducing a Treg CAR construct into the cultured T cells or NK cells.
(4) Expanding Treg CAR T cells or NK cells.
(5) Treating the subject by administering a therapeutically effective amount thereto.

The ex vivo expansion of tumor-infiltrating lymphocytes (TILs) are successfully used in the current adoptive cell therapy. In one embodiment, TILs are harvested and successfully expanded ex vivo.

In some embodiments, TILs can be obtained from a tumor tissue sample and expanding the number of TILs. Treg CAR T or NK cells were used to co-culture with TILs to deplete Treg population to enhance TIL responses to cancers, which is valuable to the disease therapies.

In some embodiments, CD4CAR bear a set of CAR body including an antigen recognition domain, a hinge region, a co-stimulatory domain (s) and an intracellular domain (CD3 zeta chain). In a further embodiment, CD4CAR depletes Tregs, and then enhances T-cell responses to cancer cells and improves therapeutic outcomes of anti-tumor activity.

In some embodiments, CD25CAR bear a set of CAR body including an antigen recognition domain, a hinge region, a co-stimulatory domain (s) and an intracellular domain (CD3 zeta chain). In a further embodiment, CD25CAR depletes Tregs, and then enhances T-cell responses to cancer cells and improves therapeutic outcomes of anti-tumor activity.

In some embodiments, the disclosed invention comprises methods and compositions of controlling the proliferation of T cells, for instance, CAR T cells or therapeutic T cells using CAMPATH. The methods further relate to compositions and methods for ablating CAR T cells using CAMPATH after tumor depletion or in emergency cases, for example, unexpected side effects caused by CAR Therapy.

In some embodiments, the disclosed invention comprises methods and compositions of controlling the proliferation of T cells, for instance, CAR T cells or therapeutic T cells using CAMPATH. The methods further relate to compositions and methods for ablating CAR T cells using CAMPATH after tumor depletion or in emergency cases, for example, unexpected side effects caused by CAR Therapy.

In some embodiments, CD52 can be co-expressed in a CAR engineered cell or any CAR engineered cell and can be used as a "safety switch" for CAR therapy. In some embodiments, CAMPATH is an idea drug for controlling CAR T cell proliferation. The preferred doses of CAMPATH is 6 mg/kg. Upon determining a need to administer CAMPATH, patients may be, for example, administered a single fixed dose of 6 mg/kg for Injection. The dose of CAMPATH is calculated individually for all patients based on the body weight. The dosage may vary according to the application, and may, in certain examples, be more in the range of 4 mg-30/kg, or in the range of 4 mg-60 mg/kg or 4 mg-100 mg/kg. In some cases, CAMPATH can be administrated to a subject with multiple doses to ensure the deletion of CAR T cells.

Generation of BCMA-IL-15/IL-15sushi CAR

Figure 103:
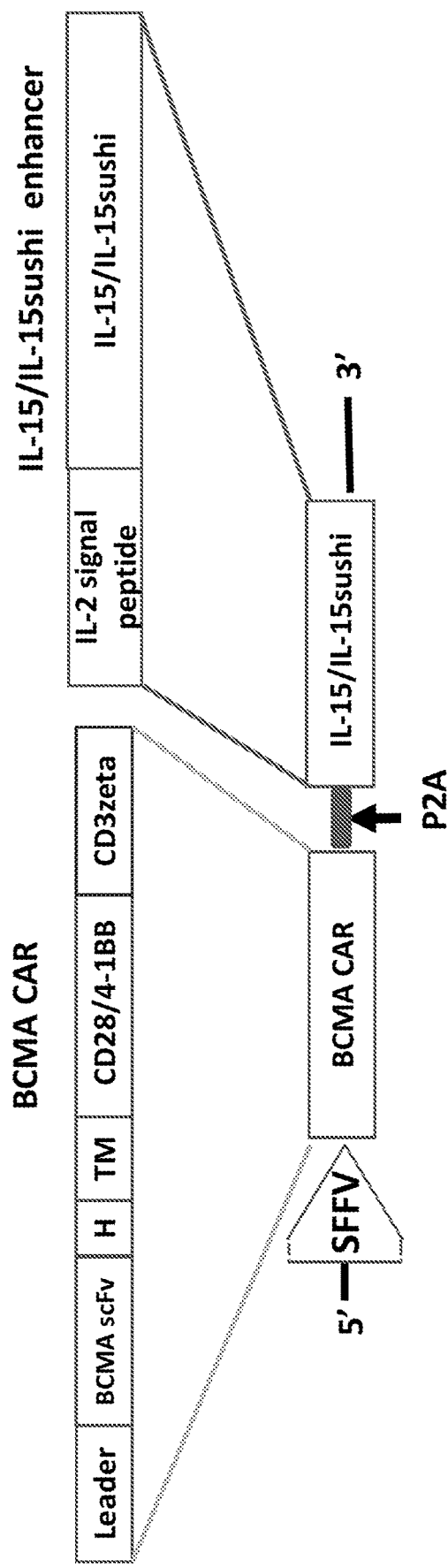

BCMA CAR was constructed as a modularized signaling domain containing: a leader sequence, scFv against BCMA antigen, a hinge domain (H), a transmembrane domain (TM), a co-stimulatory domains (4-1BB) and the intracellular signaling domain CD3 zeta (see above). BCMA-IL-15/IL-15sushi is a BCMA CAR armored with IL-15/IL-15sushi (FIG. 103).

In one embodiment, the engineered cell includes BCMA CAR linked to IL15/IL-15sushi via the P2A cleavage sequence. A polypeptide providing this embodiment includes SEQ ID No. 45, 148 and corresponding polynucleotide sequence SEQ ID No. 46, 149.

Functional Activity of BCMA-IL-15/IL-15sushi CAR

BCMA is a B cell maturation antigen and is a member of the tumor necrosis factor superfamily. BCMA play an important role in B cell maturation and plasma cell survival.

To assay the cytotoxic ability of BCMA-IL15/IL15sushi CAR T-cells, we conducted co-cultures against BCMA positive MM1S, myeloma cell lines. We found that BCMA-IL15/IL15sushi CAR T-cells could efficiently lyse MM1S in a co-culture assay (data not shown). We then tested if BCMA-IL15/IL15sushi CAR T cells could eliminate some lymphoma cells that have a very level of BCMA expression. We found that BCMA-IL15/IL15 sushi CAR T-cells also possessed a degree of anti-tumor activity against a pure B lymphoma cell line, SP53. Co-culture results reveal a dose-dependent response to the BCMA CAR T (FIGS. 104 and 105).

Current CAR technology efforts in multiple myeloma involve the use of a BCMA (CD269) targeted CAR T-cell against bulk disease spearheaded by James Kochenderfer (NIH) with limited success. Some these patients in remission after BCMA CAR treatment eventually relapse and this may be because some myeloma cells are dim (weak) or negative expression for BCMA. Heterogeneity of antigen expression is one of key features for multiple myeloma cells. Thus, more effective CAR T cell treatments to prevent relapse are urgently needed.

BCMA-IL-15/IL-15sushi CAR T or NK cells targeting tumor cells, could be a carrier to deliver an enhancer to the tumor microenvironment. BCMA-IL-15/IL-15sushi CAR T or NK cells in tumor microenvironment target tumor cells, binding to the CAR targeting antigen (BCMA) and triggering lysis multiple myeloma cells and massive secretion of soluble IL-15/IL-15sush fusion from the expansion of BCMA-IL-15/IL-15sushi CAR T cells and NK cells as well as their neighboring innate cells, which then eliminate non-target multiple myeloma cells (absent or week BCMA surface antigen expression).

In some embodiments, secreting IL-15/IL-15sushi can improve BCMA CAR T cell expansion in vitro or in vivo. In a further embodiment, secreting IL-15/IL-15sushi can enhance CAR T or NK cell persistency in vivo.

In some embodiments, the secreted IL-15/IL-15sushi protein can be involved in trafficking of other T cells, dendritic cells, macrophages and NK cells to the tumor microenvironment, which then lyse the tumor cells by supplementing the defect that BCMA CAR T or NK cells are unable to eliminate non-targeting cancer cells to prevent antigen escape or disease relapses.

In some embodiments, secreting IL-15/IL-15sush from BCMA CAR in tumor sites can overwhelms the PD-L1 ability to suppress the immune response and increase CAR T or NK cell persistency.

In some embodiments, IL-15/IL-15sushi anchor, secreting IL-15/IL-15sushi and secreting IL-15 can improve CAR T cell expansion in vitro and in vivo.

In some embodiments, IL-15/IL-15sushi anchor, secreting IL-15/IL-15sushi and secreting IL-15 can shorten harvesting time for BCMA CAR T cell culture and provide high quality of BCMA CAR cells for therapy in terms of persistency and engraftment.

In some embodiments, IL-15/IL-15sushi anchor, secreting IL-15/IL-15sushi and secreting IL-15 can improve BCMA CAR T cell therapeutic outcomes and prevent disease relapses.

In some embodiments, the compositions of the present disclosure may be used to treat asthma.

Allergic diseases include allergic asthma, hay fever, food allergies, atopic dermatitis and anaphylaxis. These diseases are caused by immune hypersensitivity to allergens in the environment. The underlying mechanism relates to immunoglobulin E antibodies (IgE) binding to an allergen and then to a receptor on mast cells or basophils where it triggers the release of inflammatory chemicals. IgE antibody plays a critical role by binding to the receptors, FceRI on mast cells, eosinophils, and basophils. FceR1 plays an important role in type I allergic reaction and is one of receptors for Fc portion of immunoglobulin E (IgE). FceR1 has a high affinity to IgE. FceR1 is also expressed in skin Langerhans cells, monocytes, eosinophils and dendritic cells.

IgE could be a membrane bound form or a secreted form. Plasma cells are the source of IgE. IgE, mast cells, basophils, and eosinophils are essential components of allergic inflammation.

It was expected found that IgE producing plasma cells persistently generate IgE as the IgE antibodies in serum is only less than 12 hours. IgE producing cells can be short- or long-lived plasma cells. It has unexpectedly been found that short-long plasma cells can be replenished continuously from activated or differentiated B cells. Targeting B cells may eliminate short-lived plasma cells but not long-lived plasma cells.

Eosinophils have been implications in pathogenesis of a number of diseases including atopic diseases, eosinophilic esophagitis, Churg-Strauss syndromes and hypereosinophilic syndromes (HES). Therefore, there is a need for the methods of reducing or eliminate eosinophils associated with diseases in a human.

HES (severe hypereosinophilic syndrome) is a group of inflammatory disorders characterized by a persistent and marked overproduction of eosinophils. HES affect approximately 20,000 patients globally. If left untreated, the symptoms of HES become progressively worse and the disease can be life-threatening.

Mast cells are implicated in or contribute to pathogenesis of a variety of diseases including autoimmune diseases, allergic diseases, tumor angiogenesis, mastocytosis, inflammatory diseases, polyarthritis, inflammatory bowel diseases (IBD), and interstitial cystitis. For this reason, it is needed to deplete the mast cells responsible for these disorders.

The compositions and methods of this disclosure can be used to generate a population of T/NK cells used for immunotherapy in the treatment of allergic disorder. The compositions and methods described in the present disclosure may be utilized in conjunction with other types of therapy for allergic diseases, such as immunosuppressant, steroids, B-cell depletion agents and so forth.

In some embodiments, the disclosure provides a method of depleting plasmablasts (short-lived), long-lived plasma in patents with allergic disorders by administering to patients CAR T cells or NK cells. CAR targeted cells are IgE producing plasma cells.

In another embodiment, the disclosure provides an engineered CAR, FceRIA CAR comprising: a signal peptide, an extracellular domain of a subunit of the high affinity IgE receptor (also called A subunit of the high affinity IgE receptor, FceRIA), a hinge region, a transmembrane domain, at least one co-stimulatory domain, and a signaling domain.

In another embodiment, the disclosure provides an engineered CAR, FceRIA CAR comprising: a signal peptide, an extracellular domain of a subunit of the high affinity IgE receptor (also called A subunit of the high affinity IgE receptor, FceRIA), a transmembrane domain, at least one co-stimulatory domain, and a signaling domain.

In some embodiments, the disclosure provides a method of an engineered CAR, FceRIA CAR depleting plasmablasts (short-lived), long-lived plasma in patients with allergic disorders by administering to patients CAR T cells or NK cells. FceRIA CAR targeted cells are IgE producing plasma cells.

In some embodiments, the disclosure provides a method of an engineered CAR, FceRIA CAR depleting secreting IgE plasma cell myeloma by administering to patients CAR T cells or NK cells. FceRIA CAR targeted cells are IgE producing plasma cells or multiple myeloma cells.

In some embodiments, the disclosure provides a method of an engineered CAR, FceRIA CAR depleting plasmablasts (short-lived), long-lived plasma in patients with allergic disorders by administering to patients CAR T cells or NK cells. The cytotoxicity for FceRIA CAR is specific for only those plasma cells bearing IgE, which provides a target therapy for allergic disorders without general immunosuppression.

In some embodiments, the disclosure provides a method of depleting B cells, immature B cells, memory B cells, plasmablasts, long lived plasma cells, or plasma cells in patients with an allergic disease by administering to patients CAR or compound CAR T cells or NK cells. CAR targeted cells are B or plasma cells expressing one or two or all the antigens, CD19, CD20, CD22, BCMA, TACI, BAFF-R (BAFFR), and IgE In some embodiments, the disclosure provides a method of depleting B cells, immature B cells, memory B cells, plasmablasts, long lived plasma cells, or plasma cells in patients with an allergic disease by administering to patients with a compound CAR targeting cells expressing IgE and/or a B cell surface antigen such as CD19, CD22 and CD20.

In some embodiments, the disclosure provides a method of depleting B cells, immature B cells, memory B cells, plasmablasts, long lived plasma cells, or plasma cells in patients with asthma by administering to patients with a compound CAR that target cells expressing IgE and/or a B cell surface antigen such as CD19, CD22 and CD20. In a further embodiment, an engineered CAR targeting both short and long-lived plasma cells that produce IgE, provides a better outcome for treatment of allergic diseases.

In some embodiments, a compound CAR targeting B cells, immature B cells, memory B cells, plasmablasts, long lived plasma cells, or plasma cells in patients with asthma would provide a better clinical outcome.

In one embodiment, the present disclosure provides a method for depleting mature, memory B cells, and short- and long lived plasma cells using one or more of the following strategies:

1) Depletion of mature, memory B cells and short, long lived plasma cells by a contacting said cells with a CAR-engineered cell having a scFv against CD19 or CD20 or CD22;
2) Depletion of short- and long-lived plasma cells by contacting said cells with a CAR engineered cell having a FceRIA specifically binding to the Fc fragment of IgE 3) Depletion of short- and long-lived plasma cells by contacting said cells with a CAR engineered cell having a scFv against BCMA or TACI or BAFF-R; or
4) Depletion of short- and long-lived plasma cells by contacting said cells with a CAR engineered cell having having an antigen recognition domain including BCMA or TACI or BAFF-R binding domain (BAFF or APRIL);

5) Deletion of mature, memory B cells, and short, long lived plasma cells contacting said cells with a compound CAR engineered cell targeting more than one different antigen to provide a reduction of disease activity for patients with allergic diseases.
6) Deletion of mature, memory B cells, and short, long lived plasma cells by contacting a CAR engineered cells that target more than one different antigen selecting from CD19, CD20, CD22, BCMA, TACI, APRIL and BAFF.

In some embodiments, a compound CAR (cCAR) targets cells expressing one or two or all of IgE, BAFF-R, BCMA, TACI, and CS1 antigens.

In some embodiments, a unit of CAR in a cCAR can comprise: 1) a scFv against either BAFF-R, BCMA, TACI and CS1; 2) a hinge region; 3) co-stimulatory domain (s) and intracellular signaling domain.

In some embodiments, FceRIA CAR can be a unit of CAR in a cCAR comprised of: 1) BCMA or TACI or BAFF-R binding domain; 2) a hinge region; 3) co-stimulatory domain (s); and intracellular signaling domain.

In a further embodiment, the Fe of IgE binding domain (FceRIA) can be a part of or entire FceRIA molecule.

In a further embodiment, BCMA or TAC1 or BAFF-R binding domain can be a part of or entire APRIL and BAFF molecules.

To provide better treatment outcomes it is critical to target multiple antigens and eliminate short- or long-lived plasma cells expressing IgE.

The invention further provides for compositions and methods of deleting IgE producing cells. The invention further provides compositions and methods of specifically depleting IgE-producing B-cells, and further lowering total serum IgE associated with allergic diseases.

In some embodiments, the disclosure provides a method of depleting mast cells, basophils and eosinophils by administering to patients with CAR T cells or CAR NK cells. CAR targeted cells are FceR1 expressing cells such as mast cells, basophils and eosinophils.

A CAR (anti-FceR1 CAR) can comprise: 1) a scFv against FceR1; 2) a hinge region; 3) co-stimulatory domain (s) and intracellular signaling domain.

In some embodiments, anti-FceR1 CAR can be used to treat diseases including, but not limited, atopic diseases, eosinophilic esophagitis, Churg-Strauss syndromes, hypereosinophilic syndromes (HES), mastocytosis, inflammatory diseases, polyarthritis, inflammatory bowel diseases (IBD), and interstitial cystitis.

In one embodiment, the disclosure provides a FceRIA CAR engineered cell that includes IL-15/IL-15sushi. In one embodiment, the present disclosure provides a method of providing long-term durable remission in patients with asthma by administering a FceRIA CAR engineered cell that includes IL-15/IL-15sushi to a patient in need thereof. Without wishing to be bound by theory, it is believed that co-expression of IL-15/IL-15sushi or 4-1BBL or IL-15/IL-15sushi anchor with a FceRIA polypeptide provides long-term durable remission in patients by increasing the sensitivity of CAR recognition of target plasmablasts, short-lived plasma and long-lived plasma cells that are responsible for IgE production, or recruiting innate immune cells to these targeted cells.

In one embodiment, the disclosure provides a FceRIA CAR engineered cell that includes IL-15/IL-15sushi anchor. In one embodiment, the present disclosure provides a method of providing long-term durable remission in patients with asthma by administering a FceRIA CAR engineered cell that includes IL-15/IL-15sushi anchor to a patient in need thereof. Without wishing to be bound by theory, it is believed that co-expression of IL-15/IL-15sushi anchor with a FceRIA polypeptide provides long-term durable remission in patients by increasing the sensitivity of CAR recognition of target plasmablasts, short-lived plasma and long-lived plasma cells that are responsible for IgE production, or recruiting innate immune cells to these targeted cells.

In one embodiment, the engineered cell includes an FceRIA chimeric antigen receptor polypeptide and 4-1BBL (SEQ ID NO. 170), and corresponding nucleotides (SEQ ID NO. 171).

In one embodiment, the present disclosure provides a method of providing long-term durable remission in patients suffering from asthma by administering a FceRIA CAR engineered cell that co-expresses 4-1BBL to a patient in need thereof. Without wishing to be bound by theory, it is believed that co-expression of 4-1BBL with a FceRIA CAR provides long-term durable remission in patients by increasing the persistence of CAR engineered cells.

Antineutrophil Cytoplasmic Autoantibodies (ANCAs) Related Disorders.

There are three systemic autoimmune small vessel vasculitis syndromes that are associated with antineutrophil cytoplasmic autoantibodies (ANCAs). The ANCA-associated vasculities (AAV) include microscopic polyangiitis (MPA), granulomatosis with polyangiitis (GPA), formerly known as Wegener's granulomatosis. and eosinophilic granulomatosis with polyangiitis (EGPA), formerly known as Churg-Strauss syndrome. The lung is commonly involved in all three syndromes and diffuse alveolar hemorrhage is a potentially life-threatening complication of each of these syndromes. Despite significant progress in the treatment of these diseases, refractory or frequently relapsing disease is commonly seen.

ANCA vasculitis is caused by antineutrophil cytoplasmic autoantibodies (ANCAs) attack neutrophils. This results in neutorphils to attack vessel walls, which creates swelling. ANCAs play a key role of pathogenesis of ANCA vasculitis. Treatment with Rituximab, a chimeric monoclonal antibody that binds to CD20 expressed by B cells, provides limited therapeutic benefits. However, ANCA producing cells, plasma cells do not express CD20. It is likely that treatment with rituximab depletes the CD20-expressing B cells, precursors of short-lived plasma cells. It is not expected that long-lived plasma cells account for a significant portion of ANCA production. These long-lived plasma cells can secret immunoglobulin for months to years.

The titers of ANCA patients treating with ANCA associated vasculitis remain elevated for years despite treatments. Targeting long-lived plasma cells is very challenging as these cells appear to be resistant to most current therapies, including anti-CD20. Therefore, the promising therapeutic approach to treat refractory or relapsing ANCA associated vasculitis is to completely deplete ANCA producing cells and these cells include precursors of short-lived plasma cells (B cells, memory B cells), short-live plasma cells and live-live plasma cells.

In some embodiments, the invention discloses a method of depleting B cells, immature B cells, memory B cells, plasmablasts, short-live plasma cells, long lived plasma cells, or plasma cells in patients with ANCA associated vasculitis by administering to patients CAR or compound CAR T cells or NK cells. CAR targeted cells are B or plasma cells expressing one or two or all the antigens, BCMA, CS1, TACI and BAFF-R, CD19, CD20, and CD22.

In some embodiments, the invention discloses a method of depleting B cells, immature B cells, memory B cells, plasmablasts, short-lived plasma cells, long lived plasma cells, or plasma cells in patients with ANCA associated vasculitis by administering to patients with compound CAR T cells or NK cells. A compound CAR targeted cells are B or plasma cells expressing CD19 or BCMA (CD269).

In some embodiments, the disclosed invention provides compositions and methods relating to a engineered cell for a compound CAR depleting mature, memory B cells, and short, long lived plasma cells for treatment of ANCA associated vasculitis. A compound CAR (cCAR) bears two independent units of CARs in a vector targeting BCMA and CD19. In some embodiments, a compound CAR bears two independent units of CARs in a cell targeting one or both of BCMA and CD19 antigens. In one embodiment, the present disclosure provides a method for depleting mature, memory B cells, and short- and long-lived plasma cells using one or more of the following strategies:
1) Depletion of mature, memory B cells and short- and long-lived plasma cells by a contacting said cells with an CAR engineered cell having a scFv against CD19;
2) Depletion of short- and long-lived plasma cells by contacting said cells with a CAR engineered cell having a scFv against BCMA.

In some embodiments, targeting more than one different antigen can be achieved by pooled CAR engineered cells, which are generated by at least two separate CAR T or NK cells. As used herein, pooled CAR engineered cells include a population of engineered cells having more than one distinct CAR polypeptide unit. By way of example, pooled engineered cells include a population of engineered cells with a distinct CAR polypeptide and a population of engineered cells with a different and distinct CAR polypeptide. Furthermore, the pooled CAR engineered cells include engineered cells having cCAR polypeptides.

The pooled CAR T or NK cells can be completed by the following steps:
1) Generate at least two separate constructs of CARs targeting different antigens;
2) Transduce individual construct to T or NK cells and expand them ex vivo in a standard medium;
3) Pool different expanded T or NK cells at an appropriate ratio; and
4) Administer pooled CAR T or NK cells to a subject.

In the alternative, the different engineered cells may be individual expanded and independently or sequentially administered.

Without wishing to be bound by theory, it is believed that IL-15/IL-15sushi, IL-15/IL-15sushi anchor, and other types of IL-15 or IL-15RA proteins or protein fragments thereof provide synergistic efficacy of a CAR polypeptide when combined with checkpoint inhibitors or modulators (e.g. anti-PD-1).

In one embodiment, the disclosure provides a BCMACAR engineered cell that includes IL-15/IL-15sushi (SEQ ID NO. 46 and 148), and corresponding polynucleotide (SEQ ID NO. 45 and 149). In one embodiment, the present disclosure provides a method of providing long-term durable remission in patients with ANCA vasculitis by administering a BCMA CAR engineered cell that includes IL-15/IL-15sushi to a patient in need thereof. Without wishing to be bound by theory, it is believed that co-expression of IL-15/IL-15sushi with a BCMA CAR polypeptide provides long-term durable remission in patients by increasing the sensitivity of CAR recognition of target B cells, immature B cells, memory B cells and plasmablasts or recruiting innate immune cells to these targeted cells.

In one embodiment, the disclosure provides a BCMACAR engineered cell that includes IL-15/IL-15sushi anchor (SEQ ID NO. 142), and corresponding polynucleotide (SEQ ID NO. 143). In one embodiment, the present disclosure provides a method of providing long-term durable remission in patients with ANCA vasculitis by administering a BCMA CAR engineered cell that includes IL-15/IL-15sushi anchor to a patient in need thereof. Without wishing to be bound by theory, it is believed that co-expression of IL-15/IL-15sushi anchor with a BCMA CAR polypeptide provides long-term durable remission in patients by increasing the sensitivity of CAR recognition of target plasmablasts, short-lived plasma cells and long-lived plasma cells or recruiting innate immune cells to these targeted cells.

In one embodiment, the disclosure provides a CD19CAR engineered cell that includes IL-15/IL-15sushi (SEQ ID NO. 59 and 174), and corresponding polynucleotide (SEQ ID NO. 60 and 175). In one embodiment, the present disclosure provides a method of providing long-term durable remission in patients with ANCA vasculitis by administering a CD19 CAR engineered cell that includes IL-15/IL-15sushi to a patient in need thereof. Without wishing to be bound by theory, it is believed that co-expression of IL-15/IL-15sushi with a CD19 CAR polypeptide provides long-term durable remission in patients by increasing the sensitivity of CAR recognition of target B cells, immature B cells, memory B cells and plasmablasts or recruiting innate immune cells to these targeted cells.

In one embodiment, the disclosure provides a CD19CAR engineered cell that includes IL-15/IL-15sushi anchor (SEQ ID NO. 192), and corresponding polynucleotide (SEQ ID NO. 193). In one embodiment, the present disclosure provides a method of providing long-term durable remission in patients with ANCA vasculitis by administering a CD19 CAR engineered cell that includes IL-15/IL-15sushi to a patient in need thereof. Without wishing to be bound by theory, it is believed that co-expression of IL-15/IL-15sushi anchor with a CD19 CAR polypeptide provides long-term durable remission in patients by increasing the sensitivity of CAR recognition of target B cells, immature B cells, memory B cells and plasmablasts or recruiting innate immune cells to these targeted cells.

In one embodiment, the disclosure provides a compound CAR (cCAR), BCMA CD19 CAR bears two independent units of CARs in a vector targeting BCMA and CD19. In one embodiment, the present disclosure provides a method of providing long-term durable remission in patients with ANCA vasculitis by administering a compound BCMA CD19 CAR engineered cell that includes IL-15/IL-15sushi or IL-15/IL-15 sushi anchor to a patient in need thereof. Without wishing to be bound by theory, it is believed that co-expression of IL-15/IL-15sushi or IL-15/IL-15sushi anchor with a compound BCMA CD19 CAR polypeptide provides long-term durable remission in patients by increasing the sensitivity of CAR recognition of target B cells, immature B cells, memory B cells, plasmablasts, short-lived plasma cells and long-lived plasma cells or recruiting innate immune cells to these targeted cells In one embodiment, the engineered cell includes a CD19 chimeric antigen receptor polypeptide and 4-1BBL (SEQ ID NO. 164), and corresponding nucleotides (SEQ ID NO. 165).

In one embodiment, the present disclosure provides a method of providing long-term durable remission in patients suffering from ANCA associated vasculitis by administering a CD19 CAR engineered cell that co-expresses 4-1BBL to a patient in need thereof. Without wishing to be bound by theory, it is believed that co-expression of 4-1BBL with a CD19 CAR provides long-term durable remission in patients by increasing the persistence of CAR engineered cells.

In one embodiment, the engineered cell includes a BCMA chimeric antigen receptor polypeptide and 4-1BBL (SEQ ID NO. 140), and corresponding nucleotides (SEQ ID NO. 141).

In one embodiment, the engineered cell includes a BCMA chimeric antigen receptor polypeptide and IL-15 (SEQ ID NO. 207) with IL-2 signal peptide, and corresponding nucleotides (SEQ ID NO. 208).

In one embodiment, the engineered cell includes a BCMA chimeric antigen receptor polypeptide and IL-15/IL-15sushi anchor (SEQ ID NO. 213), and corresponding nucleotides (SEQ ID NO. 214).

In one embodiment, the engineered cell includes a BCMA chimeric antigen receptor polypeptide and IL-15/IL-15sushi (SEQ ID NO. 215), and corresponding nucleotides (SEQ ID NO. 216).

In one embodiment, the present disclosure provides a method of providing long-term durable remission in patients suffering from ANCA associated with vasculitis by administering a BCMA CAR engineered cell that co-expresses 4-1BBL to a patient in need thereof. Without wishing to be bound by theory, it is believed that co-expression of 4-1BBL with a BCMA CAR provides long-term durable remission in patients by increasing the persistence of CAR engineered cells.

In one embodiment, the engineered cell includes a compound BCMA CAR bears two independent units of CARs in a vector targeting BCMA and CD19.

In one embodiment, the present disclosure provides a method of providing long-term durable remission in patients suffering from ANCA associated vasculitis by administering a compound BCMA CD19 CAR engineered cell that co-expresses 4-1BBL to a patient in need thereof. Without wishing to be bound by theory, it is believed that co-expression of 4-1BBL with a BCMA CD19 CAR provides long-term durable remission in patients by increasing the persistence of CAR engineered cells.

A CAR or compound CAR targeting B cells or/and plasma cells may be the only agent administrated to a subject to treat ANCAs associated disorders. One may optionally administer a second agent selecting from a group of drugs such as immunosuppressant, chemotherapeutic agent, steroid, cytotoxic agent, interferon-a products, cytokine or growth factor or antibody.

Systemic Lupus Erythematosus (SLE)

Abnormal production of autoantibodies against diverse antigens is a hallmark of SLE. B and plasma cells play a central role in MS pathogenesis and contribute to the abundant pathogenic autoantibodies produced from the plasma cells.

Several different B-cell depleted therapies have been successful at reducing the frequency of replacement. However, these types of B cell depletion therapy have little effect on the abnormal antibodies found in these patients.

The anti-CD20 Antibody rituximab, and the anti-BAFF (BLyS) antibody belimumab—were the first FDA approved drugs for SLE in decades. Despite these exciting developments, the limited clinical response in only half of the treated patients raise for further exploration of the extent and efficacy of B cells. CAR targeting B cells could provide a better approach to deplete B cells.

However, the B cell depletion treatment also has little effect on the abnormal antibody production in SLE patients. This unexpected finding strongly suggests that a further therapeutic approach beyond the depletion of B cells is critically needed.

Autoantibodies are considered to play an essential role in the SLE associated organ damage and pathogenesis of many autoimmune diseases. Their removal or reduction is the therapeutic goals evaluated by many treating physicians. There are two different compartments producing autoantibodies, which consist of short-lived and long-lived plasma cells.

It is an unexpected finding that immunosuppressive therapy and anti-CD20 monoclonal antibody therapy can eliminate substantial short-lived plasmablasts but long-lived plasma cells are resistant to these treatments. Long-lived plasma cells could remain in patients with SLE for months or years. Therefore, it is critical to deplete both short- and long-lived plasma cell populations to ensure complete block of autoantibody production to eliminate SLE.

Without wishing to be bound by theory, it is believed that a CD19 CAR or other CARs including, but not limited to, CD20CAR and CD22CAR, deplete B cells, memory B cells and plasmablasts resulting in the elimination of short-lived plasma cells. However, plasma cells usually do not express CD19, CD20, or CD22. Long-lived plasma cells cannot be depleted by these CARs.

Without wishing to be bound by theory, it is believed that a BCMA CAR or other CARs including, but not limited to, BAFF CAR, BAFFR CAR, APRIL CAR, CS1 CAR, and TACI CAR deplete short-lived and long-lived plasma cells. It is likely once one of these CARs is exhausted, short or long-lived plasma can be quickly replenished by the activation of autoreactive immune B cells and memory B cells.

To more effectively deplete short or long-lived plasma cells for autoantibody production, it is necessary to deplete the memory B cells, mature B cells and autoreactive B cells that are responsible for plasma cell regeneration.

Without wishing to be bound by theory, it is believed that elimination of long-lived plasma cells (memory plasma cells) combined with selective depletion of B-cells provides the more effective strategy for elimination of long-lived plasma cells and prevent their regeneration. This new treatment strategy could significantly improve the therapeutic outcomes for SLE patients.

In one embodiment, the disclosure provides a compound CAR (cCAR), BCMA CD19 CAR bears two independent units of CARs in a vector targeting BCMA and CD19. In one embodiment, the present disclosure provides a method of providing long-term durable remission in patients with SLE by administering an engineered compound BCMA CD19 CAR targeting B-cells, memory B cells, autoreactive B cells, plasmablast cells, short-lived plasma cells and long-lived plasma cells.

In one embodiment, the disclosure provides a compound CAR (cCAR), BCMA CD19 CAR bears two independent units of CARs in a vector targeting BCMA and CD19. In one embodiment, the present disclosure provides a method of providing long-term durable remission in patients with SLE by administering a compound BCMA CD19 CAR engineered cell that includes IL-15/IL-15sushi or 4-1BBL or IL-15/IL-15sushi anchor to a patient in need thereof. Without wishing to be bound by theory, it is believed that co-expression of IL-15/IL-15sushi or IL-15/IL-15sushi anchor with a compound BCMA CD19 CAR polypeptide provides long-term durable remission in patients by increasing the sensitivity of CAR recognition of target B cells, immature B cells, memory B cells, plasmablasts, autoreactive B cells, short-lived plasma cells and long-lived plasma cells or recruiting innate immune cells to these targeted cells.

The invention further provides a method for treating IBD in a human subject comprising to the subject an effective number of cCAR (BCMA CD19 CAR) T or NK cells and further comprising administering to the subject an effective amount of nonsteroidal anti-inflammatory drugs (NSAIDs), corticosteroids, and immunosuppressants.

In some embodiments, the invention discloses a method of depleting B cells, immature B cells, memory B cells, plasmablasts, autoreactive B cells, short-live plasma cells, long lived plasma cells, or plasma cells in patients with IBD by administering to patients CAR or compound CAR T cells or NK cells. CAR targeted cells are B or plasma cells expressing one or two or all of the antigens, BCMA, TACI and BAFF-R, CD19, CD20, and CD22.

In some embodiments, the disclosed invention provides compositions and methods relating to an engineered cell for a compound CAR depleting mature, memory B cells, and short, long lived plasma cells for treatment of SLE. A compound CAR (cCAR) bears two independent units of CARs in a vector targeting BCMA and CD19. In some embodiments, a compound CAR bears two independent units of CARs in a cell targeting one or both of BCMA and CD19 antigens. In one embodiment, the present disclosure provides a method for depleting mature, memory B cells, autoreactive B cells, and short, long lived plasma cells using one or more of the following strategies:

1) Depletion of mature, memory B cells and short, long lived plasma cells by a contacting said cells with an CAR engineered cell having a scFv against CD19;
2) Depletion of short- and long-lived plasma cells by contacting said cells with a CAR engineered cell having a scFv against BCMA.

The pooled CAR T or NK cells can be completed by the following steps:

1) Generate at least two separate constructs of CARs targeting different antigens;
2) Transduce individual construct to T or NK cells and expand them ex vivo in a standard medium;
3) Pool different expanded T or NK cells at an appropriate ratio; and
4) Administer pooled CAR T or NK cells to a subject.

In the alternative, the different engineered cells may be individually expanded and independently or sequentially administered.

In some embodiments, targeting more than one different antigen can be achieved by pooled CAR engineered cells, which are generated by at least two separate CAR T or NK cells. As used herein, pooled CAR engineered cells include a population of engineered cells having more than one distinct CAR polypeptide unit. By way of example, pooled engineered cells include a population of engineered cells with a distinct CAR polypeptide and a population of engineered cells with a different and distinct CAR polypeptide. Furthermore, the pooled CAR engineered cells include engineered cells having cCAR polypeptides.

A CAR or compound CAR targeting B cells or/and plasma cells may be the only agent administrated to a subject to treat SLE. One may optionally administer a second agent selecting from a group of drugs such as immunosuppressant, chemotherapeutic agent, steroid, cytotoxic agent, interferon-a products, cytokine or growth factor or antibody.

Multiple Sclerosis (MS):

Multiple sclerosis is an incurable disease and treatment typically focuses on slowing the progression of the disease and managing MS symptoms. There is an unmet medical need to develop a new therapy for this disease.

B cells are usually present at elevated levels in MS central nervous system (CNS) tissue and are significantly increased in MS cerebrospinal fluid (CSF). In the CSF, the presence of oligoclonal IgG bands are a hallmark of MS diagnosis. Clinical trials with the anti-CD20 monoclonal antibody rituximab have shown some beneficial effects in reducing the episode of relapse activity in MS patients. However, the B cell depletion treatment also has little or no effect on the abnormal CSF oligoclonal IgG bands in MS patients. This unexpected finding strongly indicates that a further therapeutic approach exploring the extent or degree of B cell depletion by rituximab or beyond the depletion of B cells is critically needed.

It is unexpected finding that immunosuppressive therapy and anti-CD20 monoclonal antibody therapy can eliminate substantial B cells, short-lived plasmablasts but long-lived plasma cells are resistant to these treatments. Long-lived plasma cells could remain in patients with MS for months or years.

For eliminating MS, it is critical to deplete: 1) both short- and long-lived plasma cell populations to ensure complete block of autoantibody production; 2) replenished cells for plasma cells, which are B cells, autoreactive B cells, memory B cells and plasmablasts. However, targeting long-lived plasma cells is very challenging as these cells appear to be resistant to most current therapies, including anti-CD20.

In one embodiment, the disclosure provides a method of treating MS in a subject, comprising administering an effect number of CAR T cells or NK cells targeting B-cells and plasma cells. The MS to be treated include relapsing-remitting multiple sclerosis, primary progressive multiple sclerosis, secondary progressive multiple sclerosis and progressive relapsing multiple sclerosis.

Without wishing to be bound by theory, it is believed that a CD19 CAR or other CARs including, but not limited to, CD20CAR and CD22CAR, deplete B cells, memory B cells, autoreactive B cells and plasmablasts resulting in the elimination of short-lived plasma cells and replenished cells for plasma cells in patients with MS.

Without wishing to be bound by theory, it is believed that a BCMA CAR or other CARs including, but not limited to, BAFF CAR, BAFFR CAR, APRIL CAR, CS1 CAR, and TACI CAR deplete short-lived and long-lived plasma cells. It is likely once one of these CARs is exhausted, short or long-lived plasma can be quickly replenished by the activation of autoreactive immune B cells and memory B cells in patients with MS.

In one embodiment, the disclosure provides a compound CAR (cCAR), BCMA CD19 CAR bearing two independent units of CARs in a vector targeting BCMA and CD19. In one embodiment, the present disclosure provides a method of providing long-term durable remission in patients with MS by administering an engineered compound BCMA CD19 CAR targeting B-cells, memory B cells, autoreactive B cells, plasmablast cells, short-lived plasma cells and long-lived plasma cells.

In one embodiment, the disclosure provides a compound CAR (cCAR), BCMA CD19 targeting short-lived plasma cells, long-lived plasma cells and their replenished cells including B-cells, memory B cells, autoreactive B cells and plasmablast cells.

In one embodiment, the disclosure provides a compound CAR (cCAR), BCMA CD19 targeting short-lived plasma cells, long-lived plasma cells and their replenished cells including B-cells, memory B cells, autoreactive B cells and plasmablast cells. This therapeutic approach would: 1) significantly reduce abnormal CSF oligoclonal IgG bands; 2) effectively halt the disease progression; 3) prevent disease relapse.

In one embodiment, the disclosure provides a compound CAR (cCAR), BCMA CD19 CAR bears two independent units of CARs in a vector targeting BCMA and CD19. In one embodiment, the present disclosure provides a method of providing long-term durable remission in patients with MS by administering a compound BCMA CD19 CAR engineered cell that includes IL-15/IL-15sushi or 4-1BBL or IL-15/IL-15sushi anchor to a patient in need thereof. Without wishing to be bound by theory, it is believed that co-expression of IL-15/IL-15sushi or IL-15/IL-15sushi anchor with a compound BCMA CD19 CAR polypeptide provides long-term durable remission in patients by increasing the sensitivity of CAR recognition of target B cells, immature B cells, memory B cells, plasmablasts, autoreactive B cells, short-lived plasma cells and long-lived plasma cells or recruiting innate immune cells to these targeted cells.

In some embodiments, the invention discloses a method of depleting B cells, immature B cells, memory B cells, plasmablasts, autoreactive B cells, short-live plasma cells, long lived plasma cells, or plasma cells in patients with MS by administering to patients CAR or compound CAR T cells or NK cells. CAR targeted cells are B or plasma cells expressing one or two or all the antigens, BCMA, TACI and BAFF-R, CD19, CD20, and CD22.

In one embodiment, the present disclosure provides a method for depleting mature, memory B cells, autoreactive B cells, and short- and long-lived plasma cells in patients with MS using one or more of the following strategies:
 1) Depletion of replenished cells for short-lived plasma cells and long-lived plasma cells. The replenished cells such as, not limited to, B cells, memory B cells, autoreactive B cells and plasmablast cells by a contacting said cells with an CAR engineered cell having a scFv against CD19;
 2) Depletion of short- and long-lived plasma cells by contacting said cells with a CAR engineered cell having a scFv against BCMA.

In some embodiments, targeting more than one different antigen can be achieved by pooled CAR engineered cells, which are generated by at least two separate CAR T or NK cells. As used herein, pooled CAR engineered cells include a population of engineered cells having more than one distinct CAR polypeptide unit. By way of example, pooled engineered cells include a population of engineered cells with a distinct CAR polypeptide and a population of engineered cells with a different and distinct CAR polypeptide. Furthermore, the pooled CAR engineered cells include engineered cells having cCAR polypeptides.

The pooled CAR T or NK cells can be completed by the following steps:
 1) Generate at least two separate constructs of CARs targeting different antigens;
 2) Transduce individual construct to T or NK cells and expand them ex vivo in a standard medium;
 3) Pool different expanded T or NK cells at an appropriate ratio; and
 4) Administer pooled CAR T or NK cells to a subject.

In the alternative, the different engineered cells may be individual expanded and independently or sequentially administered.

A CAR or compound CAR targeting B cells or/and plasma cells may be the only agent administrated to a subject to treat MS. One may optionally administer a second agent selecting from a group of drugs such as immunosuppressant, chemotherapeutic agent, steroid, cytotoxic agent, interferon-a products, cytokine or growth factor or antibody.

Organ Rejection:

Anti-human leukocyte antigen (HLA) alloantibodies, are considered to cause antibody-mediated rejection in solid-organ rejection. Antibody-meditated rejection plays a key role in acute allograft rejections in kidney, lung, liver and heart allografts. Antibody-meditated rejection is also associated with chronic allograft rejections. In patients with kidney transplants, presence of alloantibody is associated with an increased rate of late graft loss. The alloantibody causing potent tissue destruction is seen in hyper-acute rejection due to preformed antibody against HLA class I or ABO blood group antigens, at time of transplantation.

Each year there are numerous patients prohibited from receiving a potentially life-saving organ transplant due to pre-existing antibodies against the donor's cell surface HLA. The presence of certain donor-specific antibodies is a contraindication to organ transplantation. The presence of donor-specific antibodies may result from previous blood transfusion, pregnancy and transplantations. Patients with donor-specific antibodies need significantly longer time waiting for a matched donor organ. In addition, donor-specific antibodies could be observed after transplantation. The donor-specific antibodies have been shown to play a critical role in the development of acute or chronic rejection resulting in losing organ transplants. At present, there are few treatment options available to antibody mediated rejection including anti-CD20 monoclonal antibody (rituximab) and plasmapheresis with intravenous immunoglobulin. However, therapeutic effectiveness of these treatments is limited as the source of donor-specific antibodies is plasma cells.

Plasmaapheresis or intravenous immunoglobulin infusion could reduce the titers of donor-specific antibodies but their uses do not address the source of donor-specific antibodies.

Rituximab, a chimeric monoclonal antibody that binds to CD20 expressed by B cells or plasmaapheresis provides some therapeutic benefits. However, donor-specific antibody producing cells, plasma cells do not express CD20. It is likely that treatment with rituximab depletes the CD20-expressing B cells, precursors of short-lived plasma cells. It is unexpected that long-lived plasma cells could account for a significant portion of donor-specific antibody. These long-lived plasma cells can secret immunoglobulin for months to years. Therefore, the promising therapeutic approach to deplete donor-specific antibody producing cells and these can include precursors of short-lived plasma cells (B cells, memory B cells), short-lived plasma cells and long-lived plasma cells.

Every year there are substantial patients with cross-match positive (presence of donor-specific antibodies) who are unable to perform organ transplants, such as kidney transplants.

Reduction of donor-specific antibodies in cross-match positive patients using plasmapheresis and intravenous immunoglobulin may provide conversion of positive to negative cross-match for successful kidney transplantation in some patients. However, substantial kidney transplanted patients experience acute antibody-mediated rejection. A new strategy is urgently needed to improve the therapeutic outcomes for those cross-match positive patients.

Without wishing to be bound by theory, it is believed that a CD19 CAR or other CARs including, but not limited to, CD20CAR and CD22CAR, deplete B cells, memory B cells, autoreactive B cells and plasmablasts resulting in the elimination of short-lived plasma cells and replenished cells for plasma cells in patients with donor-specific antibodies, which need to have an organ transplant. This therapeutic approach would: 1) significantly reduce the titer of donor-specific antibodies; 3) provide robust conversion of cross-match positive to cross-match negative for successful organ transplantation in patients; 2) improve therapeutic outcomes for treatment of acute antibody-mediated injection.

Without wishing to be bound by theory, it is believed that a BCMA CAR or other CARs including, but not limited to, BAFF CAR, APRIL CAR, CS1 CAR and TACI CAR deplete short-lived and long-lived plasma cells. It is likely once one of these CARs is exhausted, short or long-lived plasma can be quickly replenished by the activation of autoreactive immune B cells and memory B cells in organ transplant patients with donor-specific antibodies.

In one embodiment, the disclosure provides a compound CAR (cCAR), BCMA CD19 CAR bears two independent units of CARs in a vector targeting BCMA and CD19. In one embodiment, the present disclosure provides a method of providing long-term durable remission in organ transplant patients with donor-specific antibodies by administering an engineered compound BCMA CD19 CAR targeting B-cells, memory B cells, autoreactive B cells, plasmablast cells, short-lived plasma cells and long-lived plasma cells.

In one embodiment, the disclosure provides a compound CAR (cCAR), BCMA CD19 targeting short-lived plasma cells, long-lived plasma cells and their replenished cells including B-cells, memory B cells, autoreactive B cells and plasmablast cells. This therapeutic approach would: 1) significantly reduce the titer of donor-specific antibodies; 2) provide robust conversion of cross-match positive to cross-match negative for successful organ transplantation in patients; 3) improve therapeutic outcomes for treatment of acute antibody-mediated injection.

In one embodiment, the disclosure provides a compound CAR (cCAR), BCMA CD19 CAR bears two independent units of CARs in a vector targeting BCMA and CD19. In one embodiment, the present disclosure provides a method of providing long-term durable remission in organ transplant patients by administering a compound BCMA CD19 CAR engineered cell that includes IL-15/IL-15 sushi or IL-15/IL-15sushi anchor to a patient in need thereof. Without wishing to be bound by theory, it is believed that co-expression of IL-15/IL-15sushi or 4-1BBL or IL-15/IL-15sushi anchor with a compound BCMA CD19 CAR polypeptide provides long-term durable remission in patients by increasing the sensitivity of CAR recognition of target B cells, immature B cells, memory B cells, plasmablasts, autoreactive B cells, short-lived plasma cells and long-lived plasma cells or recruiting innate immune cells to these targeted cells.

In some embodiments, the invention discloses a method of depleting B cells, immature B cells, memory B cells, plasmablasts, autoreactive B cells, short-lived plasma cells, long lived plasma cells, or plasma cells in patients with MS by administering to patients CAR or compound CAR T cells or NK cells. CAR targeted cells are B or plasma cells expressing one or two or all of the antigens, BCMA, TACI and BAFF-R, CD19, CD20, and CD22.

In one embodiment, the present disclosure provides a method for depleting mature, memory B cells, autoreactive B cells, and short, long lived plasma cells in organ transplant patients using one or more of the following strategies:

1) Depletion of replenished cells for short-lived plasma cells and long-lived plasma cells. The replenished cells such as, not limited to, B cells, memory B cells, autoreactive B cells and plasmablast cells by a contacting said cells with an CAR engineered cell having a scFv against CD19;
2) Depletion of short- and long-lived plasma cells by contacting said cells with a CAR engineered cell having a scFv against BCMA.

In some embodiments, targeting more than one different antigen can be achieved by pooled CAR engineered cells, which are generated by at least two separate CAR T or NK cells. As used herein, pooled CAR engineered cells include a population of engineered cells having more than one distinct CAR polypeptide unit. By way of example, pooled engineered cells include a population of engineered cells with a distinct CAR polypeptide and a population of engineered cells with a different and distinct CAR polypeptide. Furthermore, the pooled CAR engineered cells include engineered cells having cCAR polypeptides.

The pooled CAR T or NK cells can be completed by the following steps:
1) Generate at least two separate constructs of CARs targeting different antigens;
2) Transduce individual construct to T or NK cells and expand them ex vivo in a standard medium;
3) Pool different expanded T or NK cells at an appropriate ratio; and
4) Administer pooled CAR T or NK cells to a subject.

In the alternative, the different engineered cells may be individual expanded and independently or sequentially administered.

In one embodiment, the present disclosure provides a method and compositions that may be administrated as an adjunct, but not limited to, plasmapheresis therapy and/or intravenous immunoglobulin infusion.

Inflammatory Bowel Disease (IBD):

IBD is a group of disorders, and Crohn's disease (CD) and ulcerative colitis (UC) are the most common forms. IBD causes intestines to become inflamed with symptoms including abdominal pain, weight loss, diarrhea and intestinal bleeding. The dysregulation in the host immune responses play an important role in the pathogenesis of IBD.

There is no cure for IBD and many of the drugs used to help control IBD are anti-inflammatory drugs including steroids, 5ASAs, immunosuppressants such as azathioprine, methotrexate and ciclosporin. There is an unmet need for a safe and effective therapeutic agent that can provide control of active disease and induce prolonged disease remission.

Although the cause of CD and UC remains unknown, accumulating evidence indicates that IBD may result from the abnormal dysregulation of of various components of the immune system. Massive infiltrate with B cells and plasma cells are evident in the inflamed gut of patients with IBD. In addition, circulating autoimmune antibodies are seen in approximately two-thirds of IBD patients indicating that B cells and plasma cells may contribute to the pathogenesis of IBD. However, anti-CD20 monoclonal antibody (rituximab) has shown no significant effect on inducing remission. It is likely that immunosuppressive therapy and anti-CD20 monoclonal antibody therapy can eliminate substantial B cells, short-lived plasmablasts and long-lived plasma cells are resistant to these treatments.

In one embodiment, the disclosure provides the method and composition of controlling active disease and inducing prolonged disease remission by deleting both B cells and plasma cells in patients with IBD.

In one embodiment, the disclosure provides a compound CAR (cCAR), BCMA CD19 CAR bears two independent units of CARs in a vector targeting BCMA and CD19. In one embodiment, the present disclosure provides a method of controlling active disease and providing long-term durable remission in IBD patients organ transplant patients by administering an engineered compound BCMA CD19 CAR targeting B-cells, memory B cells, autoreactive B cells, plasmablast cells, short-lived plasma cells and long-lived plasma cells.

The invention further provides a method for treating IBD in a human subject with an effective number of cCAR (BCMA CD19 CAR) T or NK cells and further administering to the subject an effective amount of anti-inflammatory drugs selected from the group consisting of an aminosalicylate, an oral corticosteroid, azathioprine, methotrexate and ciclosporin.

In one embodiment, the disclosure provides a compound CAR (cCAR), BCMA CD19 CAR bearing two independent units of CARs in a vector targeting BCMA and CD19. In one embodiment, the present disclosure provides a method of providing long-term durable remission in patients with IBD by administering a compound BCMA CD19 CAR engineered cell that includes IL-15/IL-15sushi or IL-15/IL-15sushi anchor or 4-1BBL to a patient in need thereof. Without wishing to be bound by theory, it is believed that co-expression of IL-15/IL-15sushi or IL-15/IL-15sushi anchor or 4-1BBL with a compound BCMA CD19 CAR polypeptide provides long-term durable remission in patients by increasing the sensitivity of CAR recognition of target B cells, immature B cells, memory B cells, plasmablasts, autoreactive B cells, short-lived plasma cells and long-lived plasma cells or recruiting innate immune cells to these targeted cells.

In some embodiments, the invention discloses a method of depleting B cells, immature B cells, memory B cells, plasmablasts, autoreactive B cells, short-live plasma cells, long lived plasma cells, or plasma cells in patients with IBD by administering to patients CAR or compound CAR T cells or NK cells. CAR targeted cells are B or plasma cells expressing one or two or all the antigens, BCMA, TACI and BAFF-R, CD19, CD20, and CD22.

In one embodiment, the disclosure provides a compound CAR (cCAR), BCMA CD19 targeting short-lived plasma cells, long-lived plasma cells and their replenished cells including B-cells, memory B cells, autoreactive B cells and plasmablast cells. This therapeutic approach would: 1) significantly reduce the titer of donor-specific antibodies; 2) provide robust conversion of cross-match positive to cross-match negative for successful organ transplantation in patients; 3) improve therapeutic outcomes for treatment of acute antibody-mediated injection.

In one embodiment, the disclosure provides a compound CAR (cCAR), BCMA CD19 CAR bearing two independent units of CARs in a vector targeting BCMA and CD19. In one embodiment, the present disclosure provides a method of providing long-term durable remission in organ transplant patients by administering a compound BCMA CD19 CAR engineered cell that includes IL-15/IL-15 sushi or 4-1BBL or IL-15/IL-15sushi anchor to a patient in need thereof. Without wishing to be bound by theory, it is believed that co-expression of IL-15/IL-15sushi or IL-15/IL-15sushi anchor with a compound BCMA CD19 CAR polypeptide provides long-term durable remission in patients by increasing the sensitivity of CAR recognition of target B cells, immature B cells, memory B cells, plasmablasts, autoreactive B cells, short-lived plasma cells and long-lived plasma cells or recruiting innate immune cells to these targeted cells.

In some embodiments, the invention discloses a method of depleting B cells, immature B cells, memory B cells, plasmablasts, autoreactive B cells, short-live plasma cells, long lived plasma cells, or plasma cells in patients with IBD by administering to patients CAR or compound CAR T cells or NK cells. CAR targeted cells are B or plasma cells expressing one or two or all of the antigens, BCMA, TACI and BAFF-R, CD19, CD20, and CD22. Rheumatoid Arthritis, Sjögren Syndrome, Dermatomyosities, Autoimmune Hemolytic Anemia, Neuromyelitis Optica (NMO), NMO Spectrum Disorder (NMOSD) and Idiopathic Thrombocytopenic Purpura (ITP)—

Rheumatoid arthritis (RA), Sjögren syndrome, dermatomyositis (DM), polymyositis (PM), autoimmune hemolytic anemia, neuromyelitis optica (NMO) and NMO spectrum disorder (NMOSD) are chronic inflammatory disorders characterized by excessive B cells/plasma cells activation. DM and PM are part of the idiopathic inflammatory myopathies associated with high morbidity and functional disability. Neuromyelitis optica (NMO) and NMO Spectrum Disorder (NMOSD), also known as Devic's disease, is an autoimmune disorder in which autoantibodies primarily attack the optic nerves and the spinal cord.

In mouse model studies, B cells and autoantibody production are critical to the development of autoimmune disorders.

B cell depletion therapy with rituximab depleting CD20-positive B cells, has been used with limited success for chronic inflammatory disorders. However, plasma cells producing autoantibodies are already established in patients with chronic inflammatory disorders and they should be affected by rituximab as plasma cells do not express CD20 unless autoantibodies are produced by short-lived plasma cells.

If autoantibody production is from short-lived plasma cells, depletion of B cells should be effective. if autoantibody production is from long-lived plasma cells, depletion of B cells should not be effective.

In one embodiment, the disclosure provides the method and composition of controlling active disease and inducing prolonged disease remission by deleting both B cells and plasma cells in patients with chronic inflammatory disorders.

In one embodiment, the disclosure provides the method and composition of reducing autoantibody titers by deleting both B cells and plasma cells in patients with chronic inflammatory disorders.

In one embodiment, the disclosure provides a compound CAR (cCAR), BCMA CD19 targeting short-lived plasma cells, long-lived plasma cells and their replenished cells including B-cells, memory B cells, autoreactive B cells and plasmablast cells. This therapeutic approach would: 1) significantly reduce the titer of autoantibodies; 2) control active diseases; 3) providing long-term durable remission.

In some embodiments, the invention discloses a method of depleting B cells, immature B cells, memory B cells, plasmablasts, autoreactive B cells, short-live plasma cells, long lived plasma cells, or plasma cells in patients with chronic inflammatory disorders by administering to patients CAR or compound CAR T cells or NK cells. CAR targeted cells are B or plasma cells expressing one or two or all the antigens, BCMA, TACI and BAFF-R, CD19, CD20, and CD22.

The invention further provides a method for treating chronic inflammatory disorders in a human subject comprising to the subject an effective number of cCAR (BCMA CD19 CAR) T or NK cells and further comprising administering to the subject an effective amount of immunsupression agents or glucocorticoids followed by therapeutic plasma exchanges for refractory or progressive syndromes.

In one embodiment, the disclosure provides a compound CAR (cCAR), BCMA CD19 CAR bearing two independent units of CARs in a vector targeting BCMA and CD19. In one embodiment, the present disclosure provides a method of providing long-term durable remission in patients with chronic inflammatory disorders by administering a compound BCMA CD19 CAR engineered cell that includes IL-15/IL-15sushi or 4-1BBL or IL-15/IL-15sushi anchor to a patient in need thereof. Without wishing to be bound by theory, it is believed that co-expression of IL-15/IL-15sushi or 4-1BBL or or IL-15/IL-15sushi anchor with a compound BCMA CD19 CAR polypeptide provides long-term durable remission in patients by increasing the sensitivity of CAR recognition of target B cells, immature B cells, memory B cells, plasmablasts, autoreactive B cells, short-lived plasma cells and long-lived plasma cells or recruiting innate immune cells to these targeted cells.

A CAR or compound CAR targeting B cells or/and plasma cells may be the only agent administrated to a subject to treat diseases, such as Rheumatoid arthritis, Sjögren syndrome, dermatomyosities, autoimmune hemolytic anemia, Neuromyelitis optica (NMO), NMO Spectrum Disorder (NMOSD) and idiopathic thrombocytopenic purpura (ITP). One may optionally administer a second agent selecting from a group of drugs such as immunosuppressant, chemotherapeutic agent, steroid, cytotoxic agent, interferon-a products, cytokine or growth factor or antibody.

GVHD

Graft-versus-host disease (GVHD) is a major cause of morbidity and mortality after allogeneic HSCT and limits its wider use for a variety of disease treatments. In mice, B-cell depletion results in a decreased incidence of acute GVHD (Schultz K R et al. 1995). However, the depletion of B cells is incomplete but processes additional immunomodulatory effects, such as short-lived or long-lived plasma cells that are responsible for allo-antibody production. B-cell dysregulation and allo-antibody production play a critical role in pathogenesis of chronic GVHD.

In one embodiment, the disclosure provides the method and composition of controlling GVHD processes by deleting both B cells and plasma cells.

In one embodiment, the disclosure provides the method and composition of reducing autoantibody titers by deleting both B cells or plasma cells or both in patients with GVHD.

In one embodiment, the disclosure provides a BCMA CAR or CD19 CAR or compound CAR (cCAR), BCMA CD19 targeting short-lived plasma cells, long-lived plasma cells and their replenished cells including B-cells, memory B cells, autoreactive B cells and plasmablast cells. This therapeutic approach would: 1) significantly reduce autoreactive B cells; 2) significantly reduce the titer of autoantibodies; and 3) control active diseases.

In some embodiments, the invention discloses a method of depleting B cells, immature B cells, memory B cells, plasmablasts, autoreactive B cells, short-live plasma cells, long lived plasma cells, or plasma cells in patients with GVHD by administering to patients CAR or compound CAR T cells or NK cells. CAR targeted cells are B or plasma cells expressing one or two or all the antigens, BCMA, TACI and BAFF-R, CD19, CD20 and CD22.

In some embodiments, the invention discloses a method of depleting B cells, immature B cells, memory B cells, plasmablasts, autoreactive B cells, short-live plasma cells, long lived plasma cells, or plasma cells in patients with GVHD by administering to patients with BCMA CD19 cCAR. A BCMA CD19 cCAR targets short-lived plasma cells, long-lived plasma cells and their replenished cells including B-cells, memory B cells, autoreactive B cells and plasmablast cells associated with GVHD

CLL-1

C-type lectin-like molecule-1 (CLL-1) is another good candidate for eradicating AML leukemic stem cells. Like CD123, leukemic stem cells also express CLL-1. In addition, CLL-1 does not express on normal hematopoietic stem cells (CD34+CD38-). But CLL-1 expresses in a high level of subset AML cells, which are CD34+CD38- or CD34+CD38+. The CD34-CD38-positive leukemic cells are considered as leukemic stem cells.

BPDCN

Blastic plasmacytoid dendritic cell neoplasm (BPDCN) is a rare disease that affects multiple organs including the bone marrow, lymph node and skin. Outcome of this disease is very poor with a median overall survival of approximately 23 months. There is unmet need to develop more efficient treatment for this dismal disease.

Inclusion criteria for diagnosis of BPDCN can include the expression by blastic tumor cells of CD4 coupled with CD123. CD123 CAR has been used in the clinical trial for BPDCN. A CAR treatment targeting single antigen is often not sufficient to prevent cancer relapse. As shown in clinical trials for CD19 and CD22 CARs treating B acute lymphoblastic leukemia, the rate of relapse is relatively high. CD19 can be lost completely and CD22 expression can drop below the threshold for CAR activity in some treated patients. Therefore, it is essential need for the CAR field to develop a novel approach targeting at least two cancer-associated antigens to prevent the disease relapse.

In one embodiment, the disclosure provides the method and composition of equipping a T or NK cell with two or multiple units of CARs targeted to two or more different tumor-associated antigens In one embodiment, the disclosure provides a compound CAR (cCAR), CD4 CD123 targeting BPDCN cells expressing CD4 and or CD123. This therapeutic approach would: 1) offset targeted antigen escapes and 2) provide long-term durable remission.

In some embodiments, targeting more than one different antigen can be achieved by pooled CAR engineered cells, which are generated by at least two separate CAR T or NK cells. As used herein, pooled CAR engineered cells include a population of engineered cells having more than one distinct CAR polypeptide unit. By way of example, pooled engineered cells include a population of engineered cells with a distinct CAR polypeptide and a population of engineered cells with a different and distinct CAR polypeptide. Furthermore, the pooled CAR engineered cells include engineered cells having cCAR polypeptides.

The pooled CAR T or NK cells can be completed by the following steps:
1) Generate at least two separate constructs of CARs targeting different antigens, CD4 and CD123;
2) Transduce individual construct to T or NK cells and expand them ex vivo in a standard medium;

3) Pool different expanded T or NK cells at an appropriate ratio; and
4) Administer pooled CAR T or NK cells to a subject.

In the alternative, the different engineered cells may be individual expanded and independently or sequentially administered.

In one embodiment, the present disclosure provides a method and compositions that may be administrated as a monotherapy or combination therapy with chemotherapy used for AML or ALL or lymphoma.

In one embodiment, the disclosure provides an engineered chimeric antigen receptor polypeptide, the polypeptide comprising: a signal peptide, a GD2 (also called GD-2) antigen recognition domain, a hinge region, a transmembrane domain, at least one co-stimulatory domain, and a signaling domain.

In another embodiment, the disclosure provides an engineered chimeric antigen receptor polypeptide, the polypeptide comprising: a signal peptide, a GD3 antigen recognition domain, a hinge region, a transmembrane domain, at least one co-stimulatory domain, and a signaling domain.

In one embodiment, the disclosure provides an engineered chimeric antigen receptor polynucleotide that encodes for a chimeric antigen receptor polypeptide having an antigen recognition domain selective for GD2.

In one embodiment, the GD2 CAR polypeptide includes SEQ ID NO. 217 and corresponding polynucleotide sequence SEQ ID NO. 218.

In one embodiment, the GD2 CAR polypeptide includes SEQ ID NO. 219 and corresponding polynucleotide sequence SEQ ID NO. 220.

In one embodiment, the GD2 CAR polypeptide includes SEQ ID NO. 221 and corresponding polynucleotide sequence SEQ ID NO. 222.

In one embodiment, the GD2 CAR polypeptide includes SEQ ID NO. 223 and corresponding polynucleotide sequence SEQ ID NO. 224.

In one embodiment, a compound CAR, GD2-CD3 CAR polypeptide includes SEQ ID NO. 235 and corresponding polynucleotide sequence SEQ ID NO. 236.

In one embodiment, the GD3 CAR polypeptide includes SEQ ID NO. 239 and corresponding polynucleotide sequence SEQ ID NO. 240.

In one embodiment, the disclosure provides a GD2 CAR engineered cell that includes IL-15/IL-15sushi (SEQ ID NO. 233), and corresponding polynucleotide (SEQ ID NO. 234).

In one embodiment, the disclosure provides a GD2-4-1BBL CAR engineered cell that includes 4-1BBL (SEQ ID NO. 229), and corresponding polynucleotide (SEQ ID NO. 230).

In one embodiment, the disclosure provides a GD2-IL-15/IL-15sushi anchor CAR engineered cell that includes IL-15/IL-15sushi anchor (SEQ ID NO. 231), and corresponding polynucleotide (SEQ ID NO. 232).

In one embodiment, the disclosure provides a GD2-IL-15 CAR engineered cell that includes secretibg IL-15 (SEQ ID NO. 227), and corresponding polynucleotide (SEQ ID NO. 228).

In one embodiment, the disclosure provides a GD3 CAR engineered cell that includes IL-15/IL-15sushi (SEQ ID NO. 249), and corresponding polynucleotide (SEQ ID NO. 250).

In one embodiment, the disclosure provides a GD3-4-1BBL CAR engineered cell that includes 4-1BBL (SEQ ID NO. 245), and corresponding polynucleotide (SEQ ID NO. 246).

In one embodiment, the disclosure provides a GD3-IL-15/IL-15sushi anchor CAR engineered cell that includes IL-15/IL-15sushi anchor (SEQ ID NO. 247), and corresponding polynucleotide (SEQ ID NO. 248).

In one embodiment, the disclosure provides a GD3-IL-15 CAR engineered cell that includes secreting IL-15 (SEQ ID NO. 243), and corresponding polynucleotide (SEQ ID NO. 244).

In one embodiment, the disclosure provides an engineered chimeric antigen receptor polynucleotide that encodes for a chimeric antigen receptor polypeptide having an antigen recognition domain selective for GD3.

In one embodiment, the GD2 CAR (super CAR) polypeptide includes SEQ ID NO. 225 and corresponding polynucleotide sequence SEQ ID NO. 226.

In one embodiment, the GD3 CAR (super CAR) polypeptide includes SEQ ID NO. 241 and corresponding polynucleotide sequence SEQ ID NO. 242.

In one embodiment, the disclosure provides an engineered cell expressing any of the chimeric antigen receptor polypeptides described above.

In another embodiment, the disclosure provides a method of producing an engineered cell expressing a chimeric antigen receptor polypeptide or polynucleotide having an antigen recognition domain selective for GD2 and GD3. The method includes (i) providing peripheral blood cells or cord blood cells; (ii) introducing the aforementioned polynucleotide into the aforementioned cells; (iii) expanding the cells of step (ii); and (iv) isolating the cells of step (iii) to provide said engineered cell.

In one embodiment, the cCAR, GD2-GD3 cCAR polypeptide includes SEQ ID NO. 235 and corresponding polynucleotide sequence SEQ ID NO. 236.

In one embodiment, the disclosure provides a method of conferring anti-soft tissue tumors to GD2 positive tumors or GD2 positive carcinoma or GD2 positive sarcomas in a patient in need thereof. The method includes (i) administering to a patient in need thereof a therapeutically effective amount of an engineered cell expressing a CAR polypeptide having a GD2 antigen recognition domain; and (ii) optionally, assaying for immunity to GD2 positive malignant tumors in the patient.

In one embodiment, the disclosure provides a method of conferring anti-soft tissue tumors to GD3 positive tumors or GD3 positive carcinoma or GD3 positive sarcomas in a patient in need thereof. The method includes (i) administering to a patient in need thereof a therapeutically effective amount of an engineered cell expressing a CAR polypeptide having a GD3 antigen recognition domain; and (ii) optionally, assaying for immunity to GD3 positive malignant tumors in the patient.

In one embodiment, the disclosure provides a method of conferring anti-soft tissue tumors to GD2 or GD3 or both positive malignant tumors in a patient in need thereof. The method includes (i) administering to a patient in need thereof a therapeutically effective amount of an engineered cell expressing a CAR polypeptide having a GD2 or GD3 or both antigen recognition domain; and (ii) optionally, assaying for immunity to GD2 or GD3 or both positive malignant tumors in the patient.

In one embodiment, the present disclosure provides an engineered cell having a first chimeric antigen receptor polypeptide including a first antigen recognition domain GD2, a first signal peptide, a first hinge region, a first transmembrane domain, a first co-stimulatory domain, and a first signaling domain; and a second chimeric antigen receptor polypeptide including a second antigen recognition domain GD3, a second signal peptide, a second hinge region, a second transmembrane domain, a second costimulatory domain, and a second signaling domain; wherein the first antigen recognition domain is different than the second antigen recognition domain.

In another embodiment, the present disclosure provides an engineered polypeptide including a chimeric antigen receptor, GD2 or GD3 and an enhancer (s). In a further embodiment, an enhancer can be selected from at least one of the group including, but not limited, IL-2, IL-7, IL-12, IL-15, IL-15/IL-15sush, IL-15/IL-15sushi anchor, IL-15/IL-15RA, IL-18, IL-21, PD-1, PD-L1, CSF1R, CTAL-4, TIM-3, cytoplasmic domain of IL-15 receptor alpha, 4-1BBL, and TGFR beta, receptors.

In one embodiments, the GD2 CAR of the present disclosure target GD2 positive tumors including, but not limited to, medulloblastoma/primitive neuroectodermal tumor of the center nervous system (CNS), malignant glioma, neuroblastoma, retinoblastoma, ependymoma, sarcoma, melanoma, breast cancer, ovarian cancer, glioblastoma, Ewing's sarcoma and small cell lung carcinoma.

In one embodiments, the GD3 CAR of the present disclosure target GD3 positive tumors including, but not limited to, medulloblastoma/primitive neuroectodermal tumor of the center nervous system (CNS), malignant glioma, neuroblastoma, retinoblastoma, ependymoma, sarcoma, melanoma, breast cancer, ovarian cancer, glioblastoma, Ewing's sarcoma and small cell lung carcinoma.

In one embodiments, the GD2-GD3 cCAR of the present disclosure target GD2 or GD3 or both positive tumors including, but not limited to, medulloblastoma/primitive neuroectodermal tumor of the center nervous system (CNS), malignant glioma, neuroblastoma, retinoblastoma, ependymoma, sarcoma, melanoma, breast cancer, ovarian cancer, glioblastoma, Ewing's sarcoma and small cell lung carcinoma.

The present disclosure is not limited to the embodiments described and exemplified above, but is capable of variation and modification within the scope of the disclosure and claims.

While there have been described what are presently believed to be the preferred embodiments of the present disclosure, those skilled in the art will realize that other and further changes and modifications may be made thereto without departing from the spirit of the disclosure, and it is intended to claim all such modifications and changes as come within the true scope of the disclosure.

Various terms relating to aspects of the disclosure are used throughout the specification and claims. Such terms are to be given their ordinary meaning in the art, unless otherwise indicated. Other specifically defined terms are to be construed in a manner consistent with the definition provided herein.

The present disclosure may be better understood with reference to the examples, set forth below. The following examples are put forth so as to provide those of ordinary skill in the art with a complete disclosure and description of how the compounds, compositions, articles, devices and/or methods claimed herein are made and evaluated, and are intended to be purely exemplary and are not intended to limit the disclosure Administration of any of the engineered cells described herein may be supplemented with the co-administration of a CAR enhancing agent. Examples of CAR enhancing agents include immunomodulatory drugs that enhance CAR activities, such as, but not limited to agents that target immune-checkpoint pathways, inhibitors of colony stimulating factor-1 receptor (CSF1R) for better therapeutic outcomes. Agents that target immune-checkpoint pathways include small molecules, proteins, or antibodies that bind inhibitory immune receptors CTLA-4, PD-1, and PD-L1, and result in CTLA-4 and PD-1/PD-L1 blockades. As used herein, enhancing agent includes enhancer as described above.

As used herein, "patient" includes mammals. The mammal referred to herein can be any mammal. As used herein, the term "mammal" refers to any mammal, including, but not limited to, mammals of the order Rodentia, such as mice and hamsters, and mammals of the order Logomorpha, such as rabbits. The mammals may be from the order Carnivora, including Felines (cats) and Canines (dogs). The mammals may be from the order Artiodactyla, including Bovines (cows) and Swines (pigs) or of the order Perssodactyla, including Equines (horses). The mammals may be of the order Primates, Ceboids, or Simoids (monkeys) or of the order Anthropoids (humans and apes). Preferably, the mammal is a human. A patient includes subject.

In certain embodiments, the patient is a human 0 to 6 months old, 6 to 12 months old, 1 to 5 years old, 5 to 10 years old, 5 to 12 years old, 10 to 15 years old, 15 to 20 years old, 13 to 19 years old, 20 to 25 years old, 25 to 30 years old, 20 to 65 years old, 30 to 35 years old, 35 to 40 years old, 40 to 45 years old, 45 to 50 years old, 50 to 55 years old, 55 to 60 years old, 60 to 65 years old, 65 to 70 years old, 70 to 75 years old, 75 to 80 years old, 80 to 85 years old, 85 to 90 years old, 90 to 95 years old or 95 to 100 years old.

The terms "effective amount" and "therapeutically effective amount" of an engineered cell as used herein mean a sufficient amount of the engineered cell to provide the desired therapeutic or physiological or effect or outcome. Such, an effect or outcome includes reduction or amelioration of the symptoms of cellular disease. Undesirable effects, e.g. side effects, are sometimes manifested along with the desired therapeutic effect; hence, a practitioner balances the potential benefits against the potential risks in determining what an appropriate "effective amount" is. The exact amount required will vary from patient to patient, depending on the species, age and general condition of the patient, mode of administration and the like. Thus, it may not be possible to specify an exact "effective amount". However, an appropriate "effective amount" in any individual case may be determined by one of ordinary skill in the art using only routine experimentation. Generally, the engineered cell or engineered cells is/are given in an amount and under conditions sufficient to reduce proliferation of target cells.

Following administration of the delivery system for treating, inhibiting, or preventing a cancer, the efficacy of the therapeutic engineered cell can be assessed in various ways well known to the skilled practitioner. For instance, one of ordinary skill in the art will understand that a therapeutic engineered cell delivered in conjunction with the chemo-adjuvant is efficacious in treating or inhibiting a cancer in a patient by observing that the therapeutic engineered cell reduces the cancer cell load or prevents a further increase in cancer cell load. Cancer cell loads can be measured by methods that are known in the art, for example, using polymerase chain reaction assays to detect the presence of certain cancer cell nucleic acids or identification of certain cancer cell markers in the blood using, for example, an antibody assay to detect the presence of the markers in a sample (e.g., but not limited to, blood) from a subject or patient, or by measuring the level of circulating cancer cell antibody levels in the patient.

Throughout this specification, quantities are defined by ranges, and by lower and upper boundaries of ranges. Each lower boundary can be combined with each upper boundary to define a range. The lower and upper boundaries should each be taken as a separate element.

Reference throughout this specification to "one embodiment," "an embodiment," "one example," or "an example" means that a particular feature, structure or characteristic described in connection with the embodiment or example is included in at least one embodiment of the present embodiments. Thus, appearances of the phrases "in one embodiment," "in an embodiment," "one example," or "an example" in various places throughout this specification are not necessarily all referring to the same embodiment or example. Furthermore, the particular features, structures or characteristics may be combined in any suitable combinations and/or sub-combinations in one or more embodiments or examples. In addition, it is appreciated that the figures provided herewith are for explanation purposes to persons ordinarily skilled in the art and that the drawings are not necessarily drawn to scale.

As used herein, the terms "comprises," "comprising," "includes," "including," "has," "having," or any other variation thereof, are intended to cover a non-exclusive inclusion. For example, a process, article, or apparatus that comprises a list of elements is not necessarily limited to only those elements but may include other elements not expressly listed or inherent to such process, article, or apparatus.

Further, unless expressly stated to the contrary, "or" refers to an inclusive "or" and not to an exclusive "or". For example, a condition A or B is satisfied by any one of the following: A is true (or present) and B is false (or not present), A is false (or not present) and B is true (or present), and both A and B are true (or present).

Additionally, any examples or illustrations given herein are not to be regarded in any way as restrictions on, limits to, or express definitions of any term or terms with which they are utilized. Instead, these examples or illustrations are to be regarded as being described with respect to one particular embodiment and as being illustrative only. Those of ordinary skill in the art will appreciate that any term or terms with which these examples or illustrations are utilized will encompass other embodiments which may or may not be given therewith or elsewhere in the specification and all such embodiments are intended to be included within the scope of that term or terms. Language designating such nonlimiting examples and illustrations includes, but is not limited to: "for example," "for instance," "e.g.," and "in one embodiment."

In this specification, groups of various parameters containing multiple members are described. Within a group of parameters, each member may be combined with any one or more of the other members to make additional sub-groups. For example, if the members of a group are a, b, c, d, and e, additional sub-groups specifically contemplated include any one, two, three, or four of the members, e.g., a and c; a, d, and e; b, c, d, and e; etc.

As used herein, a XXXX antigen recognition domain is a polypeptide that is selective for XXXX. "XXXX" denotes the target as discussed herein and above. For example, a CD38 antigen recognition domain is a polypeptide that is specific for CD38.

As used herein, CDXCAR refers to a chimeric antigen receptor having a CDX antigen recognition domain.

As used herein, a CAR engineered cell is an engineered cell as described herein that includes a chimeric antigen receptor polypeptide. By way of example, a CD45 engineered cell is an engineered cell having a CD45 chimeric antigen receptor polypeptide as disclosed herein.

As used herein, a compound CAR (cCAR) engineered cell is an engineered cell as described herein that includes at least two distinct chimeric antigen receptor polypeptides. By way of example, a CD19CD22 compound CAR engineered cell is an engineered cell as described herein that includes a first chimeric antigen receptor polypeptide having a CD19 antigen recognition domain, and a second chimeric antigen receptor polypeptide having a CD22 antigen recognition domain.

The present disclosure may be better understood with reference to the examples, set forth below. The following examples are put forth so as to provide those of ordinary skill in the art with a complete disclosure and description of how the compounds, compositions, articles, devices and/or methods claimed herein are made and evaluated, and are intended to be purely exemplary and are not intended to limit the disclosure.

Examples

Engineered cCAR Targets Cells Expressing CD33 or CD123 or Both

Generation of Compound CAR (cCAR)

Figure 1:
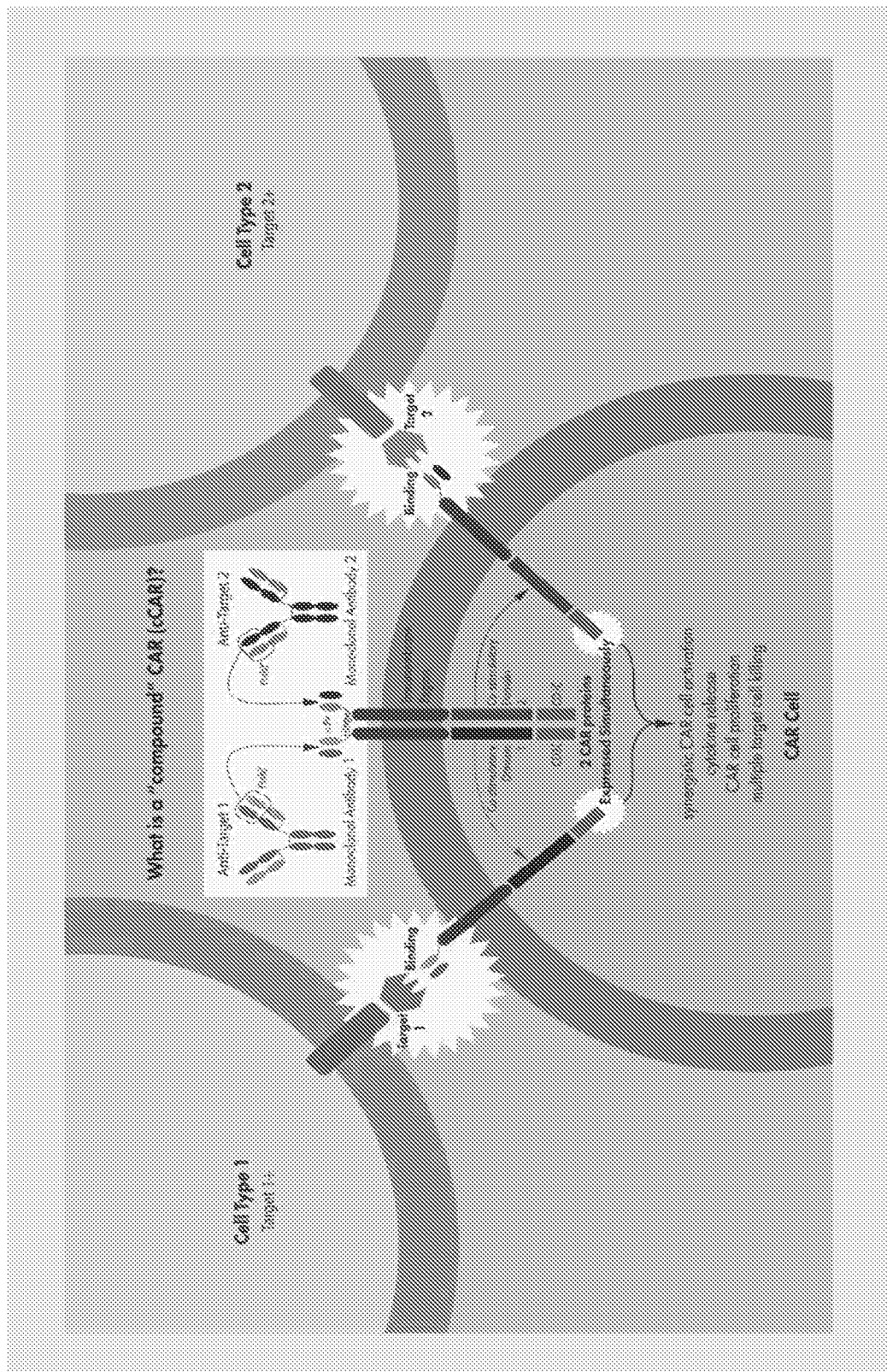
FIG. 1. A schematic representation of cCAR construct (hereinafter, "multiple CAR or compound CAR"). Multiple or compound CAR targets multiple antigens (e.g. cell type 1 or cell type 2 or the same cell type). Multiple or cCAR T cell immunotherapies comprises individual component CAR comprising a different or same antigen recognition domain, a hinge region, a transmembrane domain, various co-stimulatory domain(s) and an intracellular signaling domain.
Figure 2A:
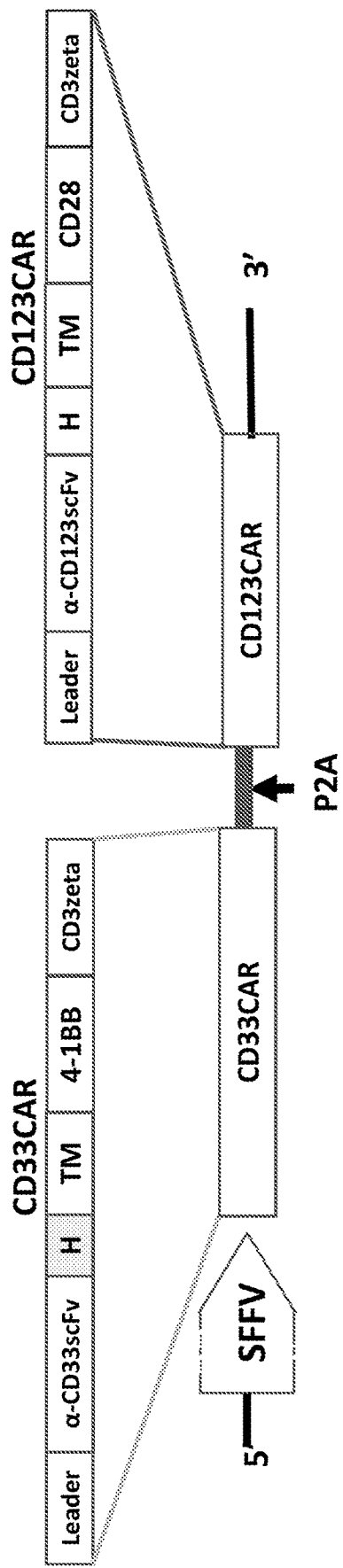
FIG. 2A. A schematic representation of cCAR-T construct. The construct comprises a SFFV promoter driving the expression of multiple modular units of CARs linked by a P2A peptide. Upon cleavage of the linker, the cCARs split and engage upon targets expressing CD33 and/or CD123. As a novel cCAR construct, the activation domains of the construct may include, but is not limited to, 4-1BB on the CD33 CAR segment and a CD28 region on the CD123 CAR.

The construction of the CD33CD123 cCAR follows the schematic in FIGS. 1 and 2A. It includes SFFV (spleen focus-forming virus) promoter that drives the expression of the functional compound CAR (cCAR) bearing two different units of CARs. The antigen receptor head, a scFv (single-chain variable fragment) nucleotide sequence of the anti-CD33 and anti-CD123. A P2A peptide derived from picornavirus is utilized due to the highly efficient mechanism of its self-cleaving dynamics for bicistronic genetic constructs. The self-cleaving P2A peptide serves to link the two independent units of CARs, CD33CAR, and CD123CAR together during expression. The advantages of this approach over an internal ribosomal entry site (IRES), which is commonly used in the literature, include its small size and high cleavage efficiency between two unit proteins upstream and downstream of the 2A peptide. In addition, the use of self-cleaving P2A peptide can avoid a problem of differences in expression levels between gene before and after IRES when IRES is applied.

The modular unit, CD33CAR includes the CD33 scFv domain, a CD8a hinge region, a CD8a transmembrane domain, 4-BB co-stimulatory domain and an intracellular domain of CD3 zeta chain. The second modular CAR, CD123CAR bears the same hinge, transmembrane and intracellular signaling domains as CD33CAR but different scFv, and co-stimulatory domains. The CD33 CAR recognizes its corresponding antigen and the CD123 CAR binds to its corresponding antigen. The hinge region was designed such that sequences where disulfide interactions are avoided. Different co-stimulatory domains, 4-BB and CD28 were used. The CD33CD123 compound CAR was subcloned into a lentiviral plasmid.

Generation of a High-Efficiency Compound CAR (cCAR)

Figure 2B:
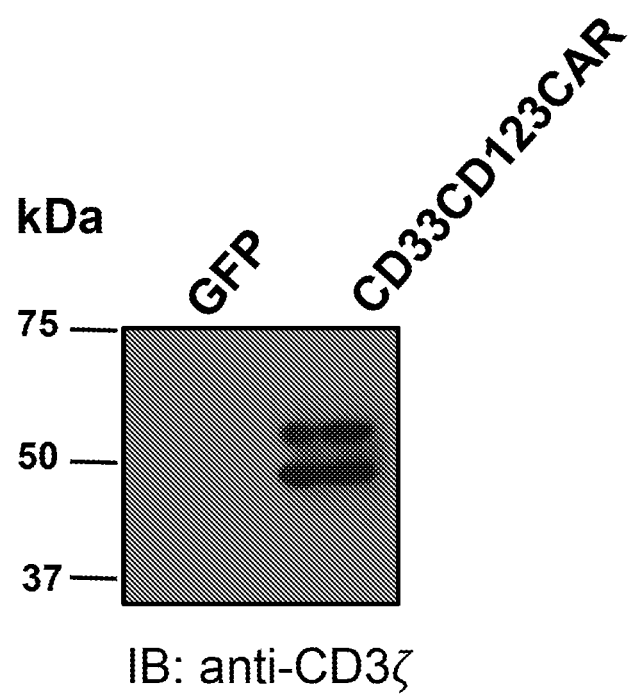
FIG. 2B. A Western blot depicting the expression of transduced CD33CD123 cCAR-T cells. The figure depicts expression of two different CAR proteins, i.e., CD33 CAR and CD123 CARs. The cCAR-T cells expressing both CD33 and CD123 CARs upon cleavage of the linker generate two distinct and consistently intense protein bands. Green Fluorescent Protein (GFP) is included as negative control.

Compound CAR lentivirus was generated by transfection of HEK-293 FT cells with Lipofectamine 2000 according to manufacturer's directions, except with 2× the vector DNA due to a large size of insert, in order to increase titer as shown in FIG. 2. After about 12-16 hours incubation, media containing Lipofectamine was removed and replaced with DMEM containing 10% FBS, 20 mM HEPES, 1 mM sodium pyruvate and 1 mM sodium butyrate. After about 24 hours, the supernatant was harvested and refrigerated, and replaced with fresh media. After about another 24 hours, this was collected and combined with the previous supernatant, and filtered through a 0.45 µM filter disc. Supernatant was split into aliquots, flash frozen with liquid nitrogen and stored at −80° C. HEK-293 FT cells were harvested, stored frozen, and lysed for subsequent electrophoresis and Western blotting (FIG. 2B).

PB (peripheral blood) or CB (human umbilical cord blood) buffy coat cells were activated 2 days with anti-CD3 antibody and IL-2. cCAR lentiviral supernatant was spinoculated onto retronectin-coated multiwell plates. Activated T cells were transduced in multiple wells with lentiviral supernatant at a low concentration of about $0.3 \times 10^6$ cells/mL to increase transduction efficiency (FIG. 3).

Following the first overnight transduction, cells were added directly to a second virus-coated plate for a second transduction without washing, unless the cells did not look healthy. Following the second overnight transduction, cells were washed, combined and incubated in tissue culture treated plates. CAR T cells were allowed to expand for up to about 5 days prior to co-culture killing assays. After about 3 days of incubation, cells were incubated with goat anti-mouse F(Ab')2 or goat IgG (isotype) antibodies conjugated with biotin, washed and followed by incubation with streptavidin-PE and conjugated anti-human CD3. After washing and suspension in 2% formalin, cells were then analyzed by flow cytometry to determine percent transduction efficiency.
Characterization of the CD33CD123 cCAR Transfected CD33CD123 cCAR HEK293T cells were subjected to Western blot analysis in order to confirm the compound construct. Immunoblot with an anti-CD3ζ monoclonal antibody showed bands of predicted size for the compound CAR CD3ζ fusion protein (FIG. 2B). Importantly, two distinct bands of similar intensity were observed on the blot signaling the successful high cleavage action of the P2A peptide as expected. No CD3ζ expression was seen for the GFP control vector as expected. The surface expression of scFv was also tested on HEK 293 cells (FIG. 2C) and primary T cells (FIG. 2C).

Figure 2C:
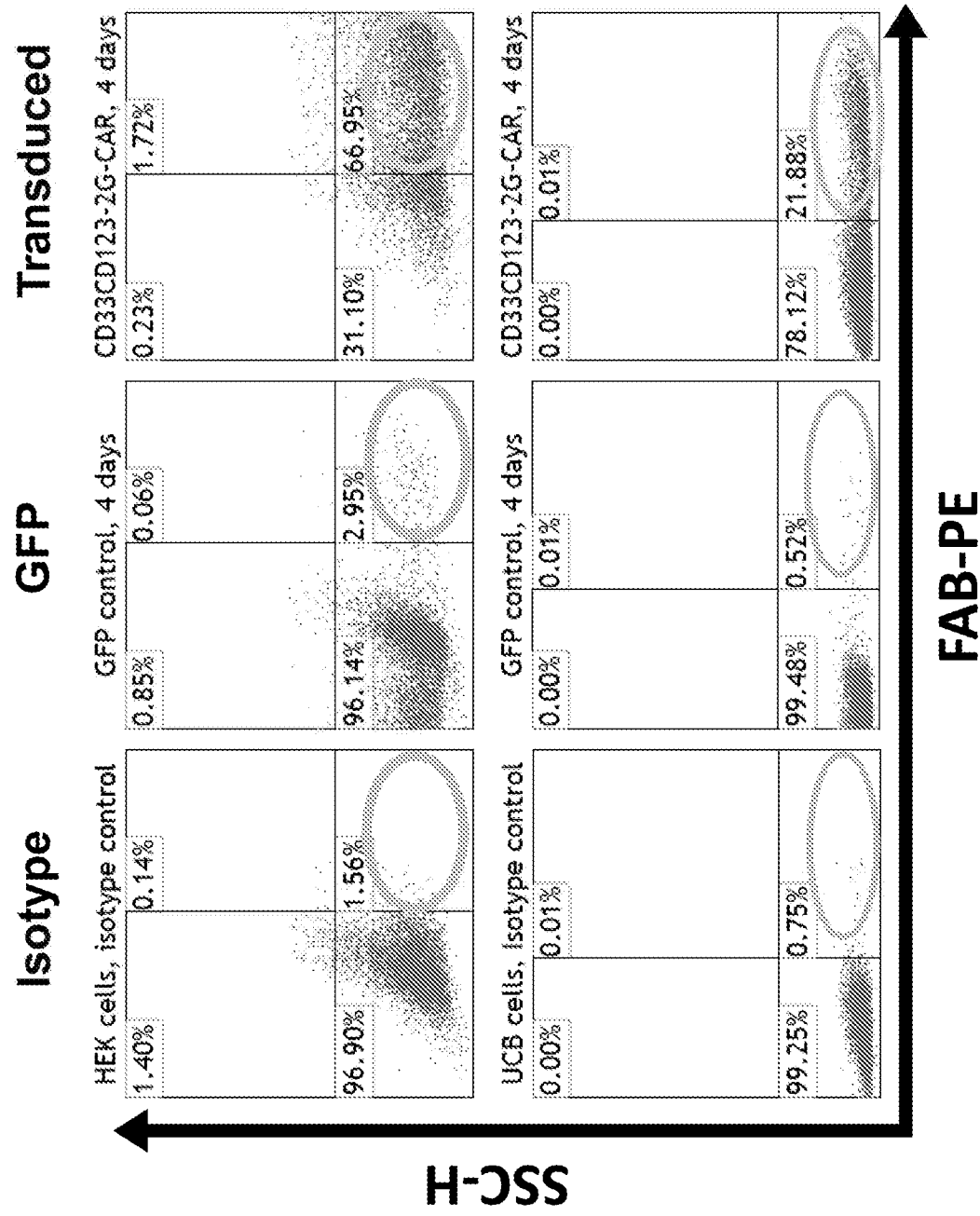
FIG. 2C. Flow cytometry representing the efficiency of transduction. Upper panel shows the lentiviral titer for CD33CD123 cCARs (also referred to as CD33CD123-2G-CAR) tested on 293FT HEK (human embryonic kidney)

The compound CD33CD23CAR lentivirus was tested for transduction efficiency in the HEK293 cell line and analyzed by flow cytometry (Beckman Coulter) (FIG. 2C). Flow cytometry showed that about 67% of HEK cells expressed CD33CD123 CARs. Human peripheral blood (PB) is often used for autologous T cell therapy. Human PB buffy coat cells were activated with anti-CD3 antibody and IL-2, and transduced with either CD4CAR or control (GFP) lentiviruses. After transduction, flow cytometry analysis showed that about 22% of T-cells expressed the CD33CD123CAR (FIG. 2C).
CD33CD123 cCAR T-Cells Derived from Umbilical Cord Blood (UCB) and Peripheral Blood (PB) Specifically Kill CD33-Expressing Tumor Cells CD33CD123 cCAR T cells or GFP T cells (control) were incubated with target cells at ratios ranging from 0.5:1 from 50:1, preferably, at about 2:1, 5:1, 10:1, 20:1, 50:1, at about 100,000, 200,000, 500,000, about 1 million, or 2 million effector cells to about 50,000, 100,000, 200,000 target cells, respectively) in about 1-2 mL T cell culture media, without IL-2 for about 24h. Target cells were leukemic cell lines and leukemia cells from a patient with leukemia. After about 24 hours of co-culture, cells were stained with mouse anti-human CD33, CD123, CD34 and CD3 antibodies.

CD33CD123 cCAR T cells expressing the CD33CAR and CD123 CAR were generated and tested for anti-leukemic functions using the HL60 and KG-1a cell lines. The HL60 cell line is a promyelocytic leukemia cell line highly enriched for CD33. About 100% of its cell population is CD33+ with a small subset (<10%) of it being dim CD123+. In culture, this cell line was tested to determine the effectiveness of the CD33CD123 CAR with an emphasis on targeting CD33-expressing leukemic cells. Additionally, due to the strong expression of CD33 in HL60, it is CD33CD123 cCAR action may be profound. Indeed, during 24h co-culture conditions with various ratios of effector to target cells, the CD33CD123 cCAR exhibited significant leukemic cell killing properties (FIG. 4). CB-derived CD33CD123 CAR T-cells were first tested for their ability to kill HL60 cells. At about 24h incubation and low effector:target (E:T) ratios ranging from about 0.5:1 to 50:1, preferably, 1:1 to about 5:1, more preferably about 2:1 to 4:1, CD33CD123 CAR cells eliminated about 55% of the CD33 expressing HL60 cells when compared to GFP control. At a ratio of about 5:1, the killing action rose to about 82%.

CD33CD123 CAR derived from peripheral blood mononuclear cells (PBMCs) were co-cultured with the myelogenous leukemia cell line KG1a, which also expresses about 100% CD33 at moderate levels compared to HL60 and 50-80% CD123. KG1a is, therefore, a relatively dual target cell population that is double positive for the antigens targeted by the CD33CD123 CAR. At about 24 hours of incubation and low effector:target (E:T) ratios ranging from about 0.5:1 to 50:1 were used. While at a low E:T ratio of about 2:1, the CD33CD123 CAR exhibited modest anti-leukemic activity about 26%, an increase in E:T ratio to 10:1 resulted in a killing of KG1a of about 62% compared to GFP control (FIG. 5), signaling that the intensity of the CD33 marker may be an indicator for the efficacy of killing with HL60 presenting strongly and harnessing more CAR action than KG1a. These experiments provide evidence for the function of the whole CD33CD123 CAR against its relevant antigen presenting cell populations.

Additional compound CAR, CD33CD123-BB cCAR has been generated (data not shown). This compound CAR comprises two independent units of CARs, CD33 and CD123. The first CAR comprises scFv binding to CD33 and the second CAR bears a different scFv recognizing CD123. Both CARs contain the same hinge region, transmembrane, co-stimulatory and intracellular domains. CD33CD123-BB cCAR lentiviruses were produced and their killing ability was tested in KG-1a cells. As shown in FIG. 5, there was substantial killing at a ratio of about 10:1 but it is less potent than that of CD33CD123 cCAR.
CD33CD123 cCAR Possesses Activity Against Patient Samples Expressing CD33 and/or CD123

In addition to cell line experiments, studies were also conducted on patient samples in order to test the function of each individual CAR unit. An aggressive acute myeloid leukemia (AML), AML-9 was used for testing efficacy of the CD33CD123 cCAR. Due to the heterogeneity of the patient cell population, which includes multiple cell types in the AML-9 sample, leukemic blasts were gated with CD34 and CD33, as they were positive for these two markers. The depletion of this CD33+CD34+ population of leukemic cells was observed to be 48% over the GFP control at a ratio of CAR T cell:target cell (FIG. 6).

Leukemic cells that were CD123 positive and CD33 negative were also tested. For this purpose, human B cell acute lymphoblastic leukemia (B-ALL) sample, Sp-BM-B6 was chosen. All leukemic blasts in this sample were CD34+ CD33−, and more than about 50% positive for CD123. Depletion of the CD34+ leukemic cell population by CD33CD123 cCAR T cells was about 86% as compared to that of the GFP control (FIG. 7). Based on the cell line and human sample studies, our data strongly suggest that the compound CD33CD123 CAR is able to target leukemic cells expressing CD33 or CD123 or both.

CD33CD123 cCAR NK Cells Targeting Leukemia Cells Expressing CD33 or CD23 or Both Natural killer (NK) cells are CD56+CD3- and can efficiently kill infected and tumor cells like CD8+ T cells. Unlike CD8+ T cells, NK cells launch cytotoxicity against tumors without the requirement of activation to kill cells. NK cells are safer effector cells, as they may avoid the potentially lethal complications of cytokine storms. However, the use of either CD33 or CD123 or both CAR NK cells in killing leukemias is entirely unexplored.

Production of CD33CD123 cCAR NK Cells

NK-92 cells were transduced with CD33CD123 CAR lentiviral supernatant in two consecutive overnight transductions with a change of retronectin- and virus-coated plates in between. The transduced cells were expanded for 3 or 4 days and then analyzed by flow cytometry for CAR expression. Cells were harvested and incubated with goat anti-mouse F(Ab')2 at about 1:250 for about 30 minutes. Cells were washed, suspended and stained with streptavidin-PE for about 30 minutes. Cells were washed and suspended in 2% formalin, and analyzed by flow cytometry. NK-92 cells expressing CD33CD123 cCAR were then labeled as above and sorted on FACSAria, with the top 0.2% of F(Ab')2-expressing cells collected and cultured. Subsequent labeling of sorted, expanded cells showed about 89% of NK-92 cell positive for anti-mouse F(Ab')2 (FIG. 8).

CD33CD123 cCAR NK Cells Efficiently Lyse or Eliminate Leukemic Cells

First, we tested the function of CD33CD123 cCAR NK-92 cells by assessing their ability to kill a HL-60 cancerous cell line in co-culture. Virtually all HL-60 cells highly express CD33 but CD123 expression in this cell line is only less than 10% (weak). Therefore, it is likely that the killing ability of CD33CD123cCAR is dependent on the ability for cCAR to properly targeting CD33.

CD33CD123 cCAR NK-92 cells were co-cultured with the HL-60 cells for about 24 hours in NK cell media without IL-2. After the incubation, the CD33CD123 cCAR NK-92 cells were labeled and compared to a control of non-CAR, GFP NK-92 cells. Dramatic killing of HL-60 cells by CD33CD123 cCAR NK-92 cells was observed as compared to the control, GFP NK-92 cells. Moreover, the killing ability of CD33CD123 cCAR NK-92 cells was dose-dependent, with a about 10 to 1 ratio of about 100% compared to the control (FIGS. 9 and 11).

A second co-culture experiment using the myeloid leukemia cell line was performed using KG1a, which expresses CD33 in all cells but at a moderate level compared to that of HL-60. The CD123 antigen is expressed in about 50-80% of KG1a cells. The experimental design was similar to the first experiment of the HL-60 killing assay described above, with the same incubation time, effector:cancer cell ratios and GFP NK-92 cell controls. Results show a remarkable killing of KG1a cells by CD33CD123 cCAR NK-92 cells in a dose-dependent manner as compared to the GFP NK-92 cell control. At a ratio of effector: target of 10:1, killing of KG1a cells by CD33CD123 cCAR NK-92 cells was about 85% as compared to that of GFP control (FIGS. 10 and 11).

Analysis of KG1a cells showed two different populations, CD33+CD123- and CD33+CD123-. FIG. 11 showed a dose dependent increase in cell killing seen in both populations. Surprisingly, the double positive population showed a higher efficient killing for each increased ratio, suggesting a possible synergistic effect of two modular CARs of CD33 and CD123 (FIG. 12).

We also generated engineered CD33CD123 CAR T cells received not only costimulation through the CD28 but also co-express the 4-1BB ligand (4-1BBL or CD137L) in a single construct, which provide the better therapeutic efficacy (FIG. 13A). T-cells derived from peripheral blood from healthy donors were transduced with the CD33CD123-4-1BBL-2G construct in 6-well plates incubated with 2 ml of virus supernatant. CAR expression was assayed with F(ab)' labeling for surface expression of the CAR protein and subsequently underwent FACS analysis. Transduced cells were compared to control T-cells labeled at the same time. Expression was determined and transduced population encircled on plot 1 day after the end of transduction period. The surface CD33CD123-41BBL-2G CAR expression on T cells was approximately 60% (FIG. 13B). CD33CD123 CAR improves functional activates when 4-1BBL was included in the construct.

An enhancer, IL-15/IL-15sushi was also included in CD33CD123 CAR construct as an alternative approach. Both compound CAR, CD33CD123 and IL-15/IL-15sushi were in a single construct (FIG. 14). IL-15/IL-15sushi is able to promote the expansion of CAR T/NK cells, and infiltrate of innate immune cells to the tumor site, which could result in better tumor destruction.

Engineered cCAR Targets Cells Expressing: 1) CD19 or CD20 or Both; 2) CD19 or CD20 or Both; 3) CD19 or CD138 or Both Generation of CD19CD20, CD19CD22, and CD19CD138 cCARs The three cCARs have been generated (FIG. 15) using the similar strategy to that of the CD33CD123 cCAR described above.

Generation of the Second Generation Compound CARs (CD19CD20 and CD19CD22)

The construction of the compound CAR (cCAR) follows the schematic in FIG. 16A. It comprises of SFFV (spleen focus-forming virus) promoter that drives the expression of the functional cCAR bearing two different units of CARs. The first CAR is the complete L8-CD19-2G CAR (using human CD8a leader sequence, called L-8), linked to the complete second CAR (either CD20-2G or CD22-2G) by a high efficient P2A self-cleaving peptide, derived from picornavirus. The entire sequence is in frame as to result in initially one large fusion protein which is cleaved in half prior to cell surface expression. This method ensures equal expression levels of both CARs. The cCAR DNA molecules were subsequently sub-cloned into the same lentiviral plasmid as above.

Transduced T Cells Efficiently Express cCARs

Lentiviral vector supernatant was generated from HEK293T cells transfected with either CD19CD20-2G or CD19CD22-2G vector construct or control vector. After collection of lentiviral supernatant was collected, cells were harvested, lysed, and electrophoresed prior to Western blot transfer. Incubation of blot membrane with anti-human CD3zeta antibody resulted in two distinct bands representing each CAR unit after cleavage; the CD19CAR is slightly larger than the CD20 or CD22 CAR units (FIG. 16B). Next, peripheral blood mononuclear buffy coat cells were activated for three days and transduced with concentrated CD19CD20-2G, CD19CD22-2G or control vector lentiviral supernatant on non-tissue culture plates coated with retronectin. The transduction procedure was repeated 24 hours after the first transduction. CAR expression on the T-cell surface was demonstrated three days after transduction by staining transduced T cells with goat anti-mouse F(Ab')2 antibody and mouse anti-human CD3.

FIG. 16 shows that 26.9% of cells transduced with concentrated L8-CD19CD20-2G lentiviral supernatant and 35.6% of T cells transduced with concentrated CD19CD22-2G lentiviral supernatant were positive for both F(Ab')2 and CD3 as determined by flow cytometry, when compared to the control transduction.

Transduced T Cells Express CD19CD22-2G at Different Levels Based on Leader Sequences We then determined the leader sequence that would result in the highest level of cell surface expression of cCAR, three constructs were made that incorporated leader sequences for human CD8a (L8), CD45 (L45), and colony stimulating factor (CSF) (FIG. 17). Following transduction of human peripheral blood T cells with lentiviral supernatant generated from each of these vectors, transduction efficiency for the T cells was determined using F(Ab')2 antibody as above. The L8 leader sequence again led to the highest transduction efficiency (43.8%), followed by L45 (9.8%) and CSF (1.3%). (FIG. 17). This shows that the optimal design of a compound CAR, like a single CAR, depends in part on the leader sequence for surface CAR expression.

Concentration of Lentiviral Supernatant can Lead to Higher Transduction Efficiency for cCARs To improve CAR efficiency in transduced T cells, lentiviral supernatant for CD19CD20-2G and CD19CD22-2G was centrifuged at 3,880×g for 24 hours. The resulting viral pellets were suspended in media at one third their original volume, making them 3× concentrated. This concentrate was used to transduce activated T cells in the same volume as non-concentrated virus. FIG. 18 shows that CAR efficiency for T cells transduced with 3× concentrated CD19CD22-2G lentiviral supernatant nearly tripled, while CAR efficiency for T cells transduced with 2.5× concentrated CD19CD20-2G lentiviral supernatant increased nearly 10-fold (FIG. 18). This illustrates the importance of concentrating lentiviral vector for the longer cCAR constructs.

cCAR CAR T Cells Specifically Target CD19-Expressing Tumor Cell Lines

T cell co-culture killing assays were performed to determine the ability of L8-CD19CD22-2G and L8-CD19CD20-2G CAR T cells to effectively lyse the CD19+ cell lines, SP53 and JeKo-1 (both mantle cell lymphoma lines). Briefly, each target cell line was pre-labeled with CMTMR membrane dye, and then co-cultured with either vector control, L8-CD19CD22-2G or L8-CD19CD20-2G CAR T cells at ratios of 2:1 and 5:1 effector:target cells (200,000 or 500,000 effector cells to 100,000 target cells, in 1 mL T cell media without serum or IL-2). After overnight incubation, cells were labeled with anti-human CD3-PerCp and CD19-APC for 30 minutes, washed, and suspended in 2% formalin for analysis by flow cytometry. The L8-CD19CD22-2G CAR T cells demonstrated robust lysis of tumor cells (FIG. 19), lysing 53.4% and 93% of the SP53 cells at 2:1 and 5:1 ratios, respectively. At the same ratios, the L8-CD19CD22-2G CAR T cells were able to lyse 69% and 97.3% of the JeKo-1 cells (FIG. 20).

cCAR CAR T Cells Eliminate CD19+ Cells from AML and B-ALL Patient Samples

Studies were again conducted using patient samples. Buffy coat fractions of these primary cells were pre-labeled with CMTMR and co-cultured with either vector control, or L8-CD19CD22-2G CAR T cells in the same manner as the tumor cell lines. L8-CD19CD22-2G CAR T cells lysed 54.3% and 77% of the AML patient cells with aberrant expression of CD19 at 2:1 and 5:1 ratios, respectively, in an overnight co-culture, and lysed 84.3% of the B-ALL tumor cells at a 1:1 ratio in a four day co-culture with 2.5% FBS and IL-2 added to the media (FIGS. 21, 22A). As these AML patient cells only comprised 65% blasts and 75% of them expressed CD19, it was likely that L8-CD19CD22-2G CAR T cells were able to eliminate the entire CD19 positive blast population.

cCAR CAR T Cells Lyse K562 Cells Expressing CD22.

An artificial K562 expressing CD22 cell line (K562×p22) via transduction into wild-type K562 cells was generated. Subsequently, we tested the anti-tumor properties of the CD19CD22 cCAR to target the minor CD22$^+$ population of the K562 cells. A co-culture experiment at 1:1 ratio (effective: target) show a modest significant cytotoxic effect on K562 expressing CD22 population compared to the control. Cytotoxicity results remain consistent with other numbers reported for anti-tumor activity against artificial antigen presenting cell lines (FIG. 22B).

Engineered cCAR Targets Cells Expressing BCMA and CS1

Generation of cCAR Including BCMA CS1 cCAR and BCMA CD19 cCAR for Treatment of Multiple Myeloma or Autoimmune Disorders Pre-clinical studies have been developed for cCARs to target surface antigens including CD38, CS1, CD138, B cell maturation antigen (BCMA) and CD38. CD19 CAR has also demonstrated some efficacy for the treatment of multiple myeloma in a phase I clinical trial. However, given that the heterogeneity of surface antigen expression commonly occurs in malignant plasma cells, it is unlikely that a single target is sufficient to eliminate this disease. BCMA CS1 cCAR, BCMA CD19 cCAR, BCMA CD38 cCAR and BCMA CD138 cCAR were generated and the experimental design was similar to that of CD33CD123 cCAR as described above.

Generation of cCAR Including BCMA CS1 cCAR (BC1cCAR) for Treatment of Multiple Myeloma or Autoimmune Disorders Generation and Characterization of BCMA-CS1 cCAR (BC1cCAR) Construct We have observed that transduction of compound CAR constructs in general lack high efficiency gene transfer rates compared to single antigen CARs. Whether due to construct size or metabolic stress on effector cells or other factors, optimization of a transduction schema for compound CARs remain necessary. We compared 3 different protocols for transductions and major differences included whether incubation occurs within viral supernatant, transduction procedure frequency, and final cell density numbers per treatment. Method 1 was a 2× transduction for 24 hours each time and uses retronectin coated plates incubated with virus first, aspirated, then incubated with T-cells to a final concentration of 0.5×10$^6$ cells/ml. Method 2 used the same viral retronectin procedure, however, it exchanged the 2nd transduction period for continued incubation to a total of 48 hours of incubation with a final cell density of 0.3×10$^6$ cells/ml. Method 2 revised uses an incubation scheme where viral supernatant was directly incubated with cells for 48 hours on a retronectin coated plate at a cell density of 0.3×10$^6$ cells/ml (FIG. 23).

Transduction Protocol Optimizations Correlate to Improved BC1cCAR Surface Expression BC cCAR's modular design consists of an anti-CD269 (BCMA) single-chain variable fragment (scFv) region fused to an anti-CD319 (CS1) scFv by a self-cleaving P2A peptide, CD8-derived hinge (H) and transmembrane (TM) regions, and 4-1BB co-activation domains linked to the CD3ζ signaling domain (FIG. 24A). A strong spleen focus forming virus promoter (SFFV) and a CD8 leader sequence were used for efficient expression of the BC1cCAR molecule on the T-cell surface. T-cells isolated from human peripheral blood buffy coats were transduced with BC1cCAR lentivirus after 2 days of activation. According to the different transduction schemas above, various transduction efficiencies are reported for each technique (FIG. 24B). We find that, in general, cells incubated with viral supernatant for 48 hours at reduced cell densities ($0.3 \times 10^6$ cells/ml) support the highest gene-transfer efficiencies (FIG. 24B). Thus, as we improve our transduction schemes, we observe a correspondingly higher rate of gene transfer (FIG. 24C).

Transfected BC cCAR HEK293T cells were subjected to Western blot analysis in order to confirm the compound construct. Immunoblot with an anti-CD3ζ monoclonal antibody showed bands of predicted size for the compound CAR CD3ζ fusion protein (FIG. 24D). Importantly, two distinct bands of similar intensity were observed on the blot signaling the successful high cleavage action of the P2A peptide as expected. No CD3ζ expression was seen for the GFP control vector as expected.

BC1cCAR T-Cells Specifically Lyse BCMA$^+$ and CS1$^+$ Myeloma Cell Lines

To assess the cytotoxicity ability of BC1cCAR T-cells, we conducted co-culture assays against myeloma cell lines: MM1S (BMCA$^+$ CS1$^{+)}$, RPMI-8226 (BCMA$^+$ CS1-), and U266 (BCMA$^+$ CS1$^{dim}$). The ability of the BC1cCAR T-cells to lyse the target cells was quantified by flow cytometry analysis, and target cells were stained with Cytotracker dye (CMTMR). In 24 hour co-cultures, the BC1cCAR exhibited virtually complete lysis of MM1S cells, with over 90% depletion of target cells at an E:T ratio of 2:1 and over 95% depletion at an E:T of 5:1 (FIGS. 25A and 25C). In RPMI-8226 cells, BC1cCAR lysed over 70% of BCMA$^+$ target cells at an E:T ratio of 2:1, and over 75% at an E:T of 5:1(FIGS. 25A and 25C). In 24 hour co-culture with U266 target cells, BC1cCAR lysed 80% of BCMA$^+$ U266 cells at an E:T ratio of 2:1, reaching saturation (FIGS. 25B and 25C). As the myeloma cell lines are all mostly BCMA$^+$, these results suggest that largely BCMA targeting by BC cCAR T-cells promotes effective cell lysis.

Figure 26A:
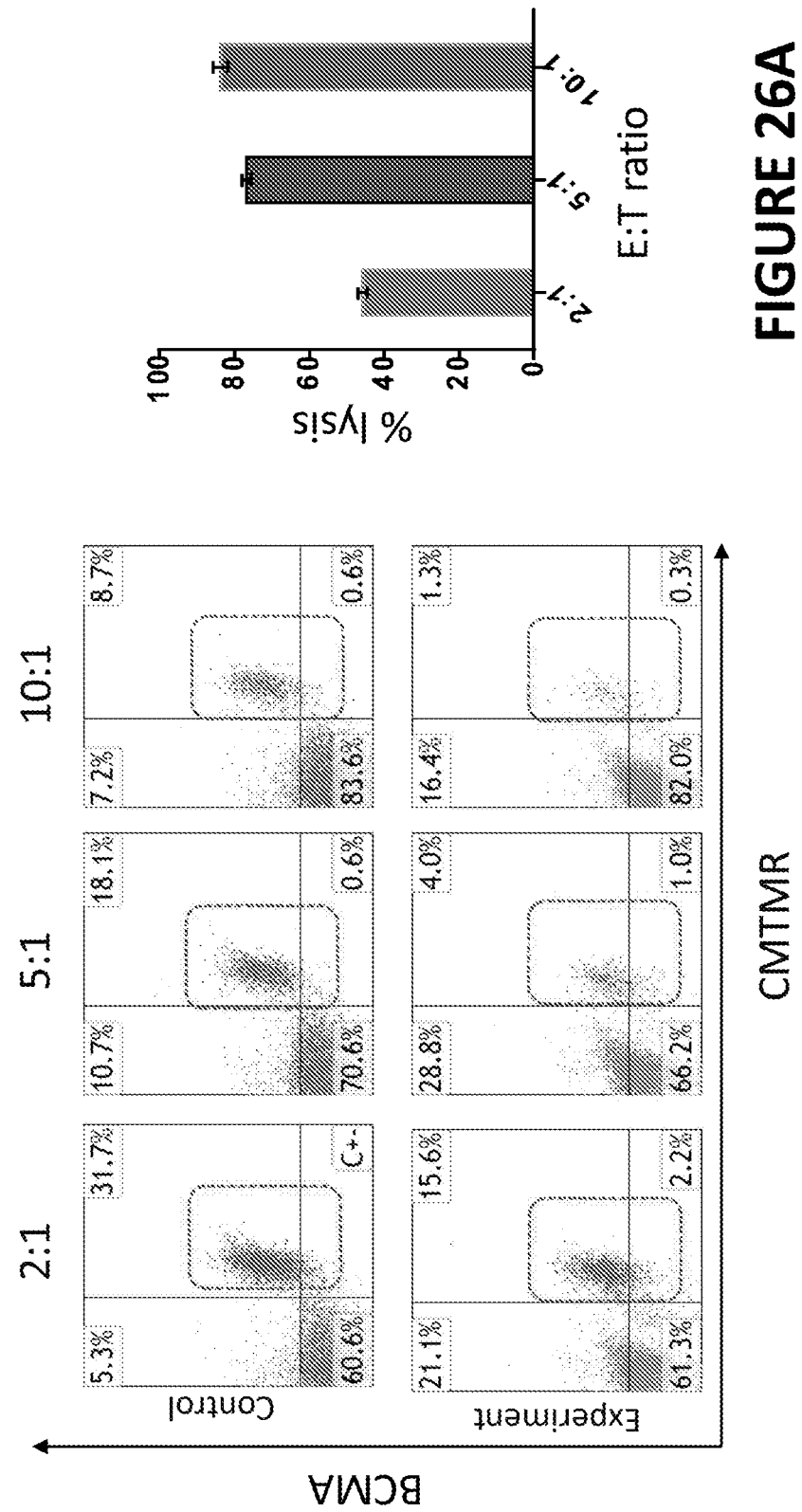

BC1cCAR T-Cells Specifically Target BCMA$^+$ and CS1$^+$ Populations in Primary Patient Myeloma Samples We conducted co-cultures using BC1cCAR T cells against primary tumor cells to evaluate their ability to kill diverse primary myeloma cell types. Flow cytometry analysis of the MM10-G primary sample reveal distinct and consistent BCMA$^+$ and CS1$^+$ population subsets. MM7-G sample shows a complete BCMA$^+$ CS1$^+$ phenotype while MM11-G exhibits a noisy BCMA$^{dim}$CS1$^{dim}$ phenotype likely attributable to its property of being a bone-marrow aspirate. BC1cCAR T-cells show robust dose-dependent ablation of the MM7-G primary patient sample, with over 75% lysis at an E:T ratio of 5:1, increasing to over 85% at 10:1 (FIG. 26A).

Figure 26B:
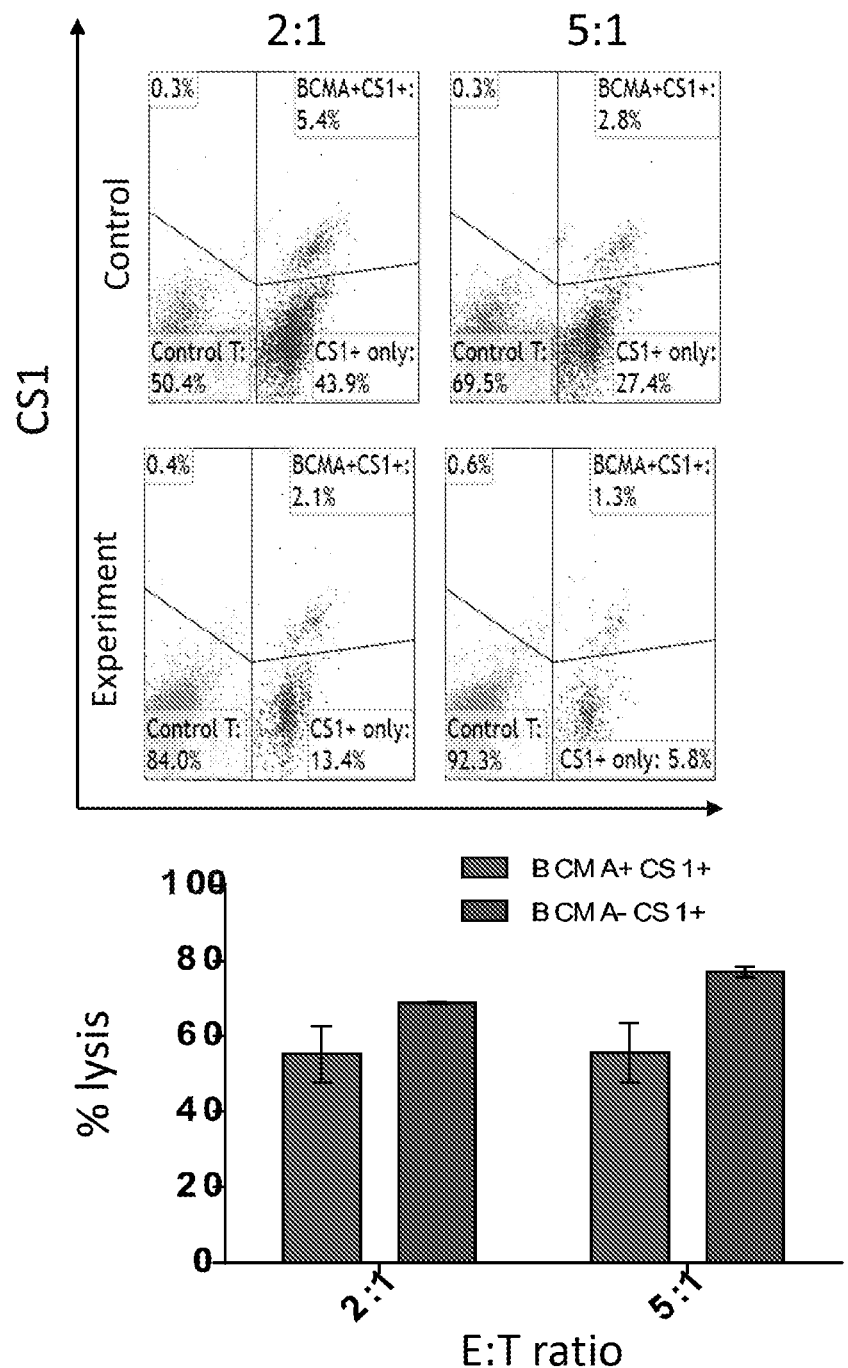
Figure 26C:
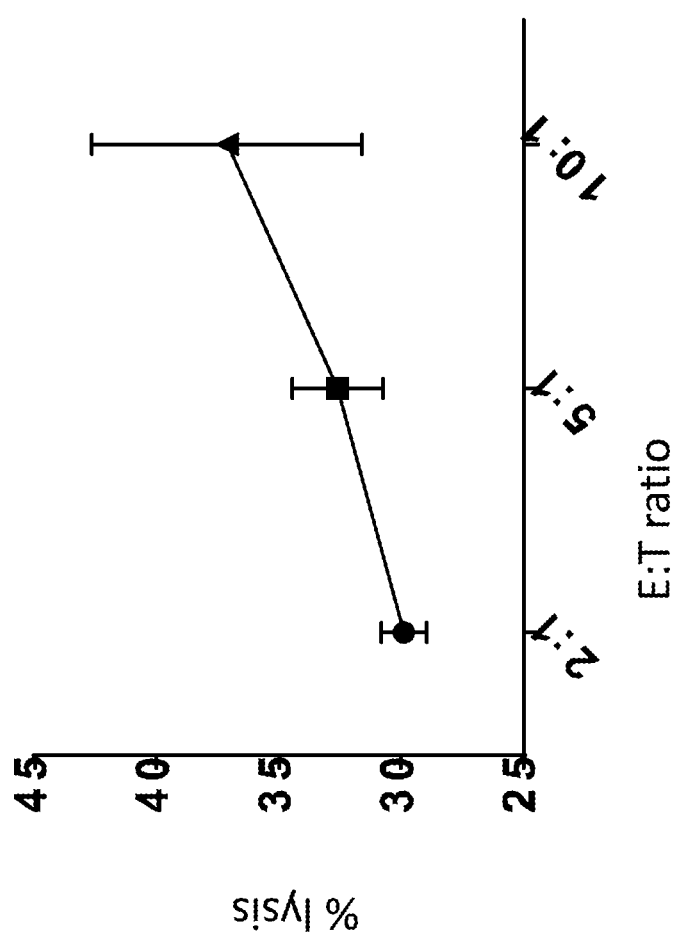
Figure 26D:
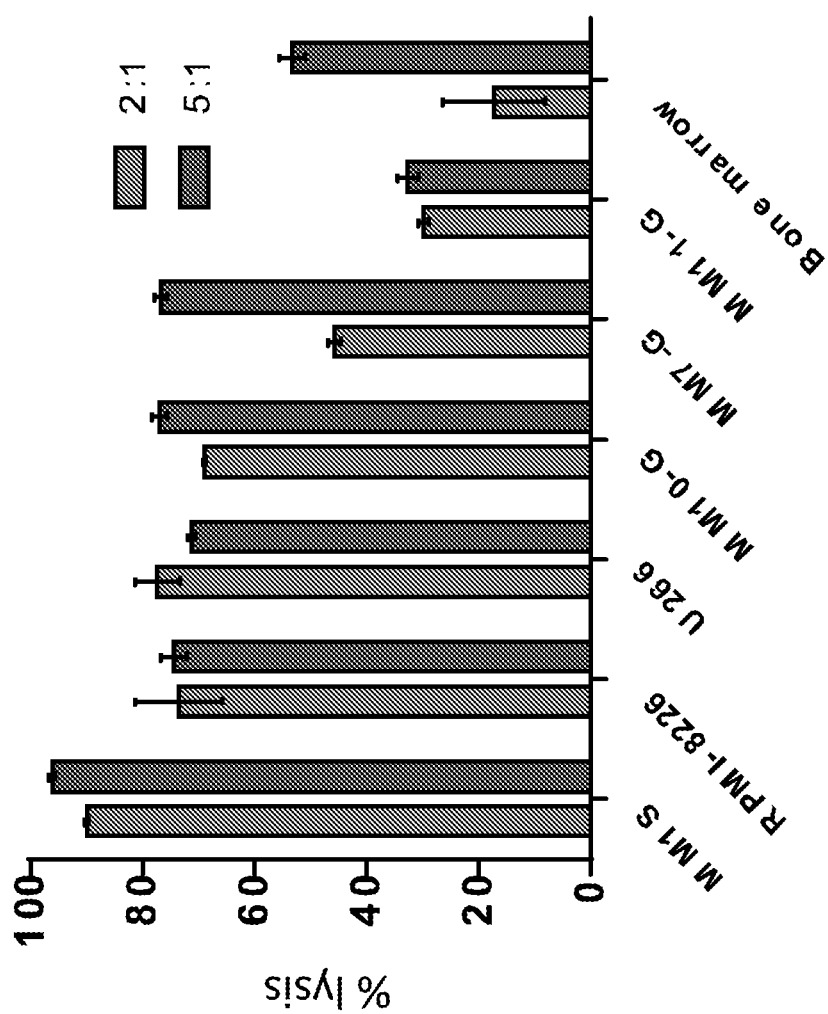

BC cCAR also show targeted and specific lysis ability, by significantly ablating both the BCMA$^+$ CS1$^+$ and the BCMA-CS1$^+$ population subsets in MM10-G co-cultures. At an E:T ratio of 2:1, BC1cCAR T-cells ablate over 60% of the BCMA$^+$ CS1$^+$ population, and 70% of the CS1$^+$ only population (FIG. 26B). At an E:T ratio of 5:1, the ablation of CS1$^+$ only population increases to 80% (FIG. 26B). Against the MM11-G (FIG. 26C), BC1cCAR T-cells were also able to demonstrate cytotoxic activity in a dose-dependent manner as well (FIG. 26C). In summary, BC1cCAR T cells exhibit robust anti-tumor activity against both myeloma cell lines and primary tumor cells presenting different combinations of BCMA and CS1 (FIG. 26D)

Functional Evaluation of BC1cCAR Antigenic Specific Activity

Figure 27A:
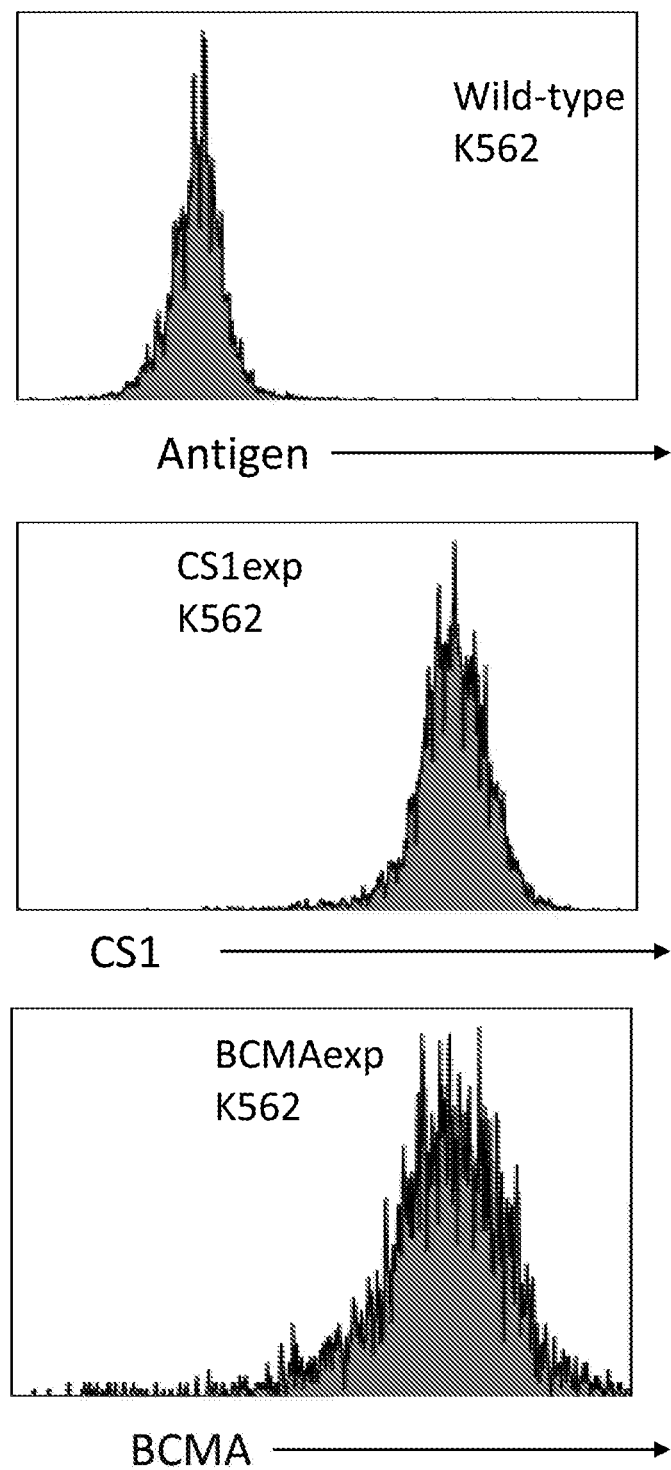

To assess and characterize the biological properties of the BC1cCAR in terms of its antigenic targeting, we established a model that would allow us to test the BC1cCAR scFv functionality independently. Using a CML cell line negative for myeloma markers (K562), we established a stable CS1 expressing K562 cell line (CS1×pK562) by transducing CS1 cDNA into K562 cells and subsequently promoting stable expression through puromycin selection (FIG. 27A). To test the BCMA scFv functionality, we obtained a BCMA expressing K562 cell line (BCMA×pK562) from the NIH (Kochenderfer Lab). After we confirmed the independent expression of each antigen for each antigen expressing cell line (FIG. 27A), we used them in co-culture experiments to determine BC1cCAR T targeting functionality.

In short-term cultures (<24 hrs), BC cCAR T-cells exhibited cytotoxic activity against BCMA×pK562 cells while showing no effect against wild-type K562 cells (FIG. 27B). Next, short-term cultures against CS1×pK562 cells show similar responses against CS1 expressing target cells. Furthermore, BC1cCAR T-cells appeared to have a stronger cytotoxic effect than a CS1-specific CAR against CS1× pK562 cells (FIG. 27B). Further validation of the anti-CS1 activity was performed on CS1$^{dim}$ expressing NK-92 cells where cytotoxicity exhibited as a dose-dependent effect (FIG. 27B).

Figure 27C:
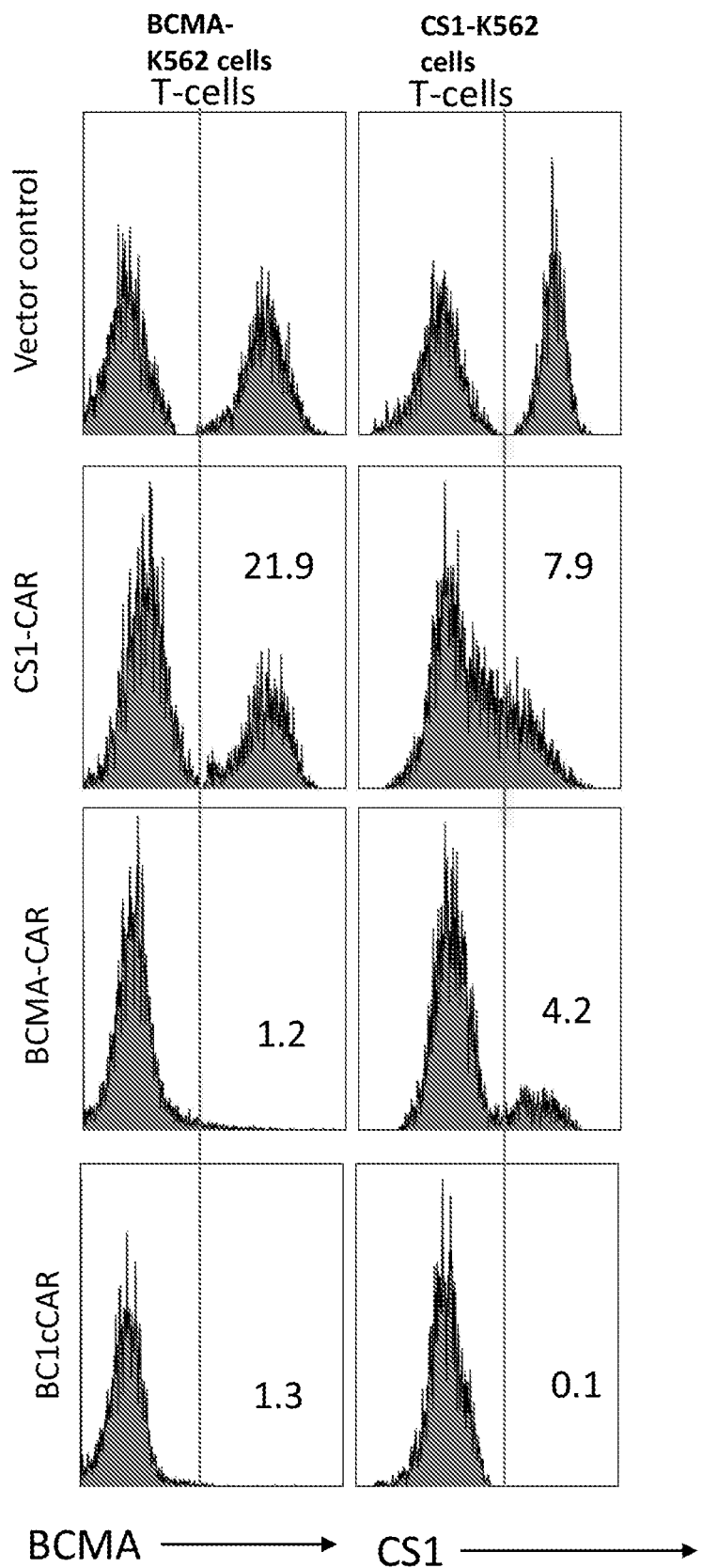

To model antigen escape in potential clinical scenarios, we conducted combined co-culture experiments. We mixed BCMA×pK562 and CS1×pK562 in 1:1 ratios and looked for evidence of antigen residual populations that could lead to relapse in real world scenarios. Co-cultures were carried out over 48 hours to ensure antigen depletion. Next, histograms were constructed that represents populations of T-cells and target tumor cells. The numbers in each histogram plot represents the residual gated target tumor population. We found that compared to control T-cells, a BCMA-specific CAR and a CS1-specific CAR were able to deplete or have profound cytotoxic effects against their respective populations. However, a CS1-specific CAR left a significant residual BCMA$^+$ population, whereas a BCMA-specific CAR achieved a high degree of cytotoxicity but still left a small but definite CS1$^+$ population (FIG. 27C). In contrast, the BC1cCAR T-cells effectively depleted both target populations (FIG. 27C). We speculate that residual tumor populations possessing 1 antigen may lead to relapse in patients that have undergone treatment using only a single antigen-specific CAR.

Since normal bone marrow expresses a small subset of plasma cells that can express CS1, there are concerns that a CS1 directed CAR could be adversely cytotoxic. While the CS1 population in bone marrow is indeed affected by the BC cCAR in a dose-dependent manner (FIG. 27D), the CS1 subset itself is small.

BC1cCAR T-Cells Exhibit Persistency and Sequential Killing Ability Even with Tumor Re-Challenge We next investigated the ability of BC1cCAR T-cells to kill tumor cells in a sequential manner under unfavorable microenvironments caused by cell lysis, debris, and tumor re-challenge. Using the scheme in FIG. 28A, we conducted long-term co-cultures using MM1S cells as a model myeloma tumor and periodically re-challenged BC cCAR T-cells and other CAR constructs with fresh MM1S to simulate tumor expansion or relapse. The initial co-culture condition was done at an E:T ratio of 1:1. With no exogenous cytokines, we find that depletion of target antigens is accomplished by all CAR cells after 48 hours, with significant clustering and T-cell proliferation (FIG. 28B). In contrast, control T-cells show no response and proliferation yielding a tumor population that has now expanded by twice its initial number. After re-challenging all treatment wells with fresh MM1S cells we find that all CARs still retain a high degree of cytotoxicity even without exogenous cytokines. By 108 hours, the newly inputted MM1S cells have been virtually depleted by both BCMA-CAR and the BC1cCAR with significant cytotoxicity still observed from the CS1-CAR. However, at this stage, flow cytometry show a diminished CS1-CAR population and a relative growth in the tumor antigen population to ~17% (FIG. 28C), suggesting that the CS1-CAR T-cells may be faltering. At this time point, the control T-cells have been completely overgrown by tumor cells. All CAR tumor-lysis and cytotoxicity stopped after 168 hours, however, BCMA-CAR and BC1cCAR still show detectable minority T-cell populations while control T-cells and CS1-CAR T-cells have all virtually disappeared (data not shown).

BC1cCAR T-Cells Exhibit Significant Control and Reduction of Tumor In Vivo

In order to evaluate the in vivo anti-tumor activity of BC1cCAR T-cells, we developed a xenogeneic mouse model using NSG mice sublethally irradiated and intravenously injected with luciferase-expressing MM1S cells, a multiple myeloma cell line, to induce measurable tumor formation. Three days following tumor cell injection, mice were intravenously injected with $5 \times 10^6$ BC1cCAR T-cells or control GFP cells in a single dose. On days 3, 6, 8 and 11, mice were injected subcutaneously with RediJect D-Luciferin (Perkin Elmer) and subjected to IVIS imaging to measure tumor burden (FIG. 29A). Average light intensity measured for the BC1cCAR T-cell injected mice was compared to that of GFP control mice in order to determine the control of tumor growth by BC1cCAR treatment (FIG. 29B). Unpaired T test analysis revealed an extremely significant difference (P<0.01) between the two groups by Day 6 with less light intensity and thus less tumor burden in the BC1cCAR T-cell injected group compared to control (FIG. 29B). Next, we compared mouse survival across the two groups (FIG. 29C). All of the BC1cCAR T-cell injected mice survived past day 50 and over a quarter remained past day 65. P-value between control and treated mice is 0.0011 based on Long-Rank Mantel-Cox test. The percent survival of control T-cell injected mice started to decrease shortly by Day 50 and were deceased by Day 55. In summary, these in vivo data indicate that BC1cCAR T-cells significantly reduce tumor burden and prolong survival in MM1S-injected NSG mice when compared to control cells.

BC1cCAR T-Cells Exhibit Improved Cytotoxic Effect in a Mixed Antigen Xenogeneic Mouse Model.

To evaluate the dual targeting nature of the compound CAR that may preclude antigen escape, we designed a xenogeneic mouse model using NSG mice sublethally irradiated and intravenously injected with luciferase-expressing K562 cells expressing either stably transduced BCMA or CS1. BCMA and CS1 expressing K562 cells were further sorted for expression following puromycin selection and established as stable homogenous single antigen populations. BCMA and CS1 expressing K562 cells were then mixed at a 4:1 ratio respectively before injection to model potential antigen escape. Three days following tumor cell injection, mice were intravenously injected with a course $15 \times 10^6$ control T-cells, BCMA-specific CAR, or BC1cCAR T-cells. Two control mice died as a result of injection procedure as a result of technical issues during T-cell infusion and cell aggregation. On days 3, 7, 10 and 12, mice were injected subcutaneously with RediJect D-Luciferin (Perkin Elmer) and subjected to IVIS imaging to visualize tumor burden (FIG. 29D). Average light intensity (signifying tumor burden) measured for the BC cCAR T-cell injected mice was compared to that of a BCMA-specific CAR and GFP control injected mice in order to determine the control of tumor growth by treatment (FIG. 29D). By day 10, both the BCMA-specific CAR and BC1cCAR T-cells exhibited over 47% tumor reduction compared to control. However, there was a 6% difference in the tumor burden reduction in favor of the BC1cCAR as early as day 10 on the dorsal side of the mice. By day 12, there was a 17% difference in tumor reduction in favor of BC1cCAR (FIGS. 29D and E) on the dorsal side. This number approaches the percentage of CS1-K562 cells injected (20%) versus BCMA-K562 (80%). It is likely the result of CS1 expressing K562 cells surviving and proliferating as a model for antigen escape. In summary, these in vivo data indicate that BC1cCAR T-cells appeared to show improved tumor burden control for multiple antigen populations.

BC1cCAR Transduction and Validation of Anti-Tumor Properties in NK Cells

Figure 31C:
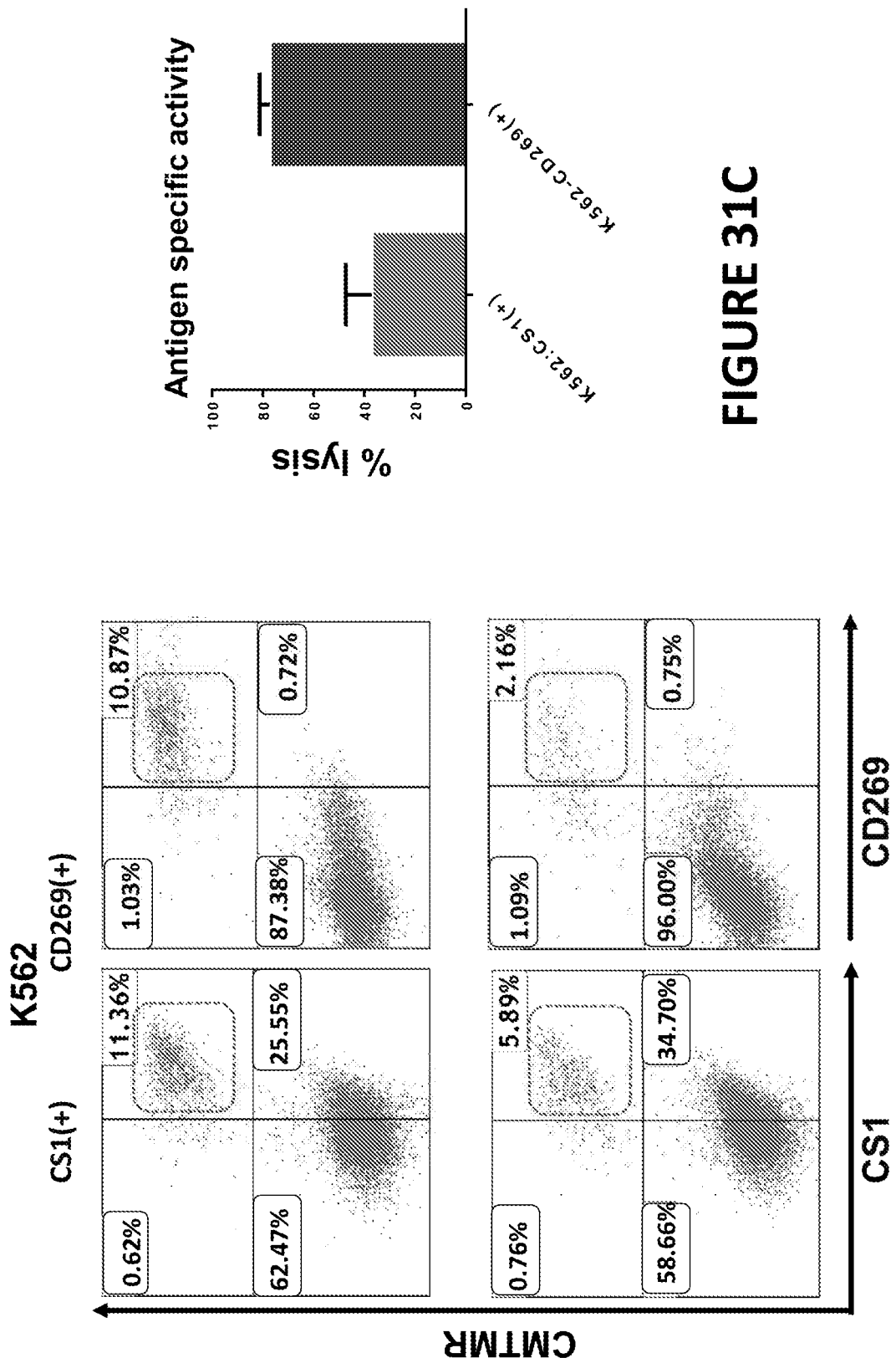

To further evaluate the robustness of BC1cCAR in different settings, we transduced the BC cCAR construct into a model NK cell line, NK-92. The construct was successfully able to be transduced via lentiviral incubation for 48 hours into NK-92 cells and resulted in a surface expression profile of 62.1% after gene-transfer (FIGS. 30A and 30B). Maintenance of NK-92 cells at densities of $0.3$-$0.5 \times 10^6$ cells/ml resulted in stable populations. To test for BC1cCAR anti-tumor activity in vitro, we conducted co-cultures against myeloma cell lines and a primary patient sample. The BC1cCAR approached 80% lysis against MM1S, U266, and RPMI-8226 cell lines at E:T ratios of 5:1 in culture. It also successfully lysed over 60% of the primary MM7-G tumor (FIGS. 31A and 31B). These results are similar in terms of comparability with BC1cCAR T-cells. Next, we assayed the antigen specificity of the BC1cCAR in its ability to lyse BCMA$^+$ or CS1$^+$ cell independently. Similar assays were carried out for BC1cCAR T-cells (FIG. 27). In 4 hour cultures with either BCMA expressing K562 (BCMAx pK562) or CS1 expressing K562 (CS1xpK562 cells), we find that the BC1cCAR NK cells are able to have cytotoxic effects against either population (FIG. 31C).

Generation of cCAR Including BCMA CD19 or BCMA CD19b for Treatment of Plasma Cell Myeloma or Autoimmune Disorders Generation and Characterization of BCMA-CD19 cCAR or BCMA-CD19b cCAR Construct BC1cCAR's modular design consists of an anti-CD269 (BCMA) single-chain variable fragment (scFv) region fused to an anti-CD19 scFv by a self-cleaving P2A peptide, CD8-derived hinge (H) and transmembrane (TM) regions, and 4-1BB co-activation domains linked to the CD3ζ signaling domain (FIG. 35). A strong spleen focus forming virus promoter (SFFV) and a CD8 leader sequence were used for efficient expression of the BCMA CD19cCAR molecule on the T-cell surface and anti-tumor activities in vitro and in vivo using a similar approach described above.

Each of units of CAR in the BCMA CD19 CAR were tested for its anti-plasma cell or anti-B cell activity. We found that the BCMA CAR unit was able to potently lyse any BCMA$^+$ population. We first conducted co-cultures against the dual BCMA CS1 positive plasma cell line MM1S and used a CS1 CAR as a secondary measure for robustness. We observed that both BCMA and CS1 specific CARs were able to lyse MM1S targets at high efficiency (FIG. 36A). Next, we cultured the BCMA CAR and CS1 CAR against a majority BCMA$^+$ primary myeloma sample MM7-G. We find that, with regard to BCMA expression, the BCMA CAR was able to virtually deplete all BCMA$^+$ cells. In contrast, the CS1 CAR left a residual BCMA$^+$ population (FIG. 36B). These results suggest that a BCMA CAR achieves high potency and specificity in its cytotoxic effect.

We next tested the CD19 CAR unit for its anti-B cell activity. The single-chain variable fragment (scFv) nucleotide sequences of the anti-CD19 molecule was used for two different constructs, CD19-2G and CD19b-BB CAR. To improve signal transduction, the CD19CAR was designed with 4-1BB co-activation domain fused to the CD3zeta signaling domain, making it a second generation CAR (FIG. 37A). CD19-targeting second generation CAR T-cells have previously been used in clinical trials. For efficient expression of the CD19CAR molecule on the T cell surface, a strong spleen focus-forming virus promoter (SFFV) was used and the leader sequence of CD8a was incorporated in the construct. For comparison, CD19CAR constructs using the leader sequences of CD45, CSF, human albumin (HA) or IL-2 were also made. The anti-CD19 scFv was separated from the intracellular signaling domains by CD-8 derived hinge (H) and transmembrane (TM) regions (FIG. 37). The CD19CAR DNA molecules, with different leader sequences or different scFv sequences, were also subsequently subcloned into a lentiviral plasmid.

Transduced T Cells Efficiently Express CD19CAR—Lentiviral vector supernatant was generated from HEK293T cells transfected with CD19-2G vector construct and control vector. After collection of lentiviral supernatant was collected, cells were harvested, lysed, and electrophoresed prior to Western blot transfer. Incubation of blot membrane with anti-human CD3zeta antibody resulted in a ~56 kDa band in the lane containing lysate from cells transfected with CD19-2G, the predicted size for the expressed fusion protein (FIG. 37B). Next, peripheral blood mononuclear buffy coat cells were activated for three days and transduced with L8-CD19-2G, or control vector lentiviral supernatant on non-tissue culture plates coated with retronectin. The transduction procedure was repeated 24 hours after the first transduction. CAR expression on the T-cell surface was demonstrated three days after transduction by staining transduced T cells with goat anti-mouse Fab antibody and mouse anti-human CD3. FIG. 37C shows that 19.8% of cells transduced with the L8-CD19-2G virus were positive for both F(Ab')2 and CD3 as determined by flow cytometry, when compared to the control transduction.

Transduced T Cells Express CD19-2G at Different Levels Based on Leader Sequences—To determine the leader sequence that would result in the highest level of cell surface expression of CD19-2G CAR, several constructs were made that incorporated leader sequences for human CD8a (L8), CD45 (L45), colony stimulating factor (CSF), human albumin (HA), and IL2 (FIG. 38A). Following transduction of human peripheral blood T cells with lentiviral supernatant generated from each of these vectors, transduction efficiency for the T cells was determined using F(Ab')2 antibody as above. Only the CD19-2G construct incorporating the L8 leader sequence resulted in any appreciable cell surface expression of CAR (32.5%), while the L45 leader sequence resulted in only 3.3% transduction efficiency, and CSF, HA and IL2 were below 1% (FIG. 38B). This shows that the optimal design of CD19-2G CAR depends in part on the leader sequence used.

Transduced T Cells Express CD19-2G at Different Levels Based on scFv Sequences

To determine the scFv sequence of CD19 that would result in the highest level of cell surface expression of CD19-2G CAR, two different sequences were used in the design of CD19-2G CAR (FIG. 39A), CD19 and CD19b. Both used the L8 leader sequence. Following transduction of human peripheral blood T cells with lentiviral supernatant generated from each of these vectors under the same condition, transduction efficiency for the T cells was determined using F(Ab')2 antibody as above. The CD19-2G construct resulted in 18.2% CAR cells, but the CD19b-BB-2G construct resulted in 54.7% CAR efficiency (FIG. 39b). This shows that the optimal design of CD19-2G CAR also depends in part on the sequence of the scFv used.

CD19-2G and CD19b-BB-2G CAR T Cells Specifically Target CD19-Expressing Cell Lines T cell co-culture killing assays were performed to determine the ability of CD19-2G and CD19b-BB-2G CAR T cells to effectively lyse the CD19+ cell lines, SP53 and JeKo-1 (both mantle cell lymphoma lines). Briefly, each target cell line was pre-labeled with CMTMR membrane dye, and then co-cultured with either vector control, L8-CD19-2G or L8-CD19b-BB-2G CAR T cells at ratios of 2:1 and 5:1 effector:target cells (200,000 or 500,000 effector cells to 100,000 target cells, in 1 mL T cell media without serum or IL-2). After overnight incubation, cells were labeled with anti-human CD3-PerCp and CD19-APC for 30 minutes, washed, and suspended in 2% formalin for analysis by flow cytometry. Both CD19-2G and CD19b 2G CAR T cells displayed robust lysis of B cell lines, SP53 and Jeko-1 (FIGS. 40 and 41).

CD19-2G and CD19b-BB-2G CAR T Cells Eliminate CD19+ Cells from AML and B-ALL Patient Samples Studies were also conducted using patient samples. Two patients with CD19+ cells were used: one diagnosed as AML (aberrant expression of CD19), and one with B-ALL, were used in the study. The patients' blood contained 26.4% and 90% of CD19+ cells, respectively (FIGS. 41A, 42A). Buffy coat fractions of these primary cells were pre-labeled with CMTMR and co-cultured with either vector control, L8-CD19-2G or L8-CD19b-BB-2G T cells in the same manner and ratios as the tumor cell lines. Both L-8-CD19-2G CAR and L-8-CD19b-2G cells were able to complete eliminate the target cells expressing CD19 (FIGS. 42 and 43).

Viral titers generally decrease as the size of insert increases and the sequence of CD19b scFv provided a higher titer for CD19b CAR (FIG. 39). Therefore, CD19b scFv was used to generate the compound BCMA CD19b CAR (FIG. 44). BCMA CD19b CAR.

An Alternative CAR Design for Myeloma and Plasma Cells

We designed a ligand expressing CAR that binds to various B-cell activation factor receptors. While it seems a logical leap to design CARs for any potential antigen or ligand factor that can be bound to a tumor population, technical troubleshooting in CAR technology is still a high and persistent barrier. Not all CAR constructs are able to achieve consistent or sufficient surface expression as a result of undefined molecular interactions or design problems. We were able to achieve surface expression of CD45 leader sequence BAFF-CAR with a CD28 intracellular signaling domain of around 21% (FIG. 45A). However, BAFF-CARs with alternate leader sequences from CD8 or CSF did not achieve any meaningful expression (FIG. 45B). Yet another factor was observed when CAR design was considered. We designed BAFF-CAR constructs using the 4-1BBL ligand binding domain as a supportive stimulatory pathway in one case. In another, we added an IL-15/IL-15sushi armor expressing arm to the construct. The CD8 leader sequence paired with the 4-1BBL or the IL-15/IL-15sushi both achieved higher surface expression than the CSF leader sequence in both cases (FIG. 45C).

Anti-Plasma Cell Properties of the BAFF-CARs

We characterized the biological properties of the various BAFF-CARs by culturing them with either plasma cell myeloma cells (MM1S) or mantle (MCL) cells (SP53) that all express a component of the plasma cell marker CD138 to which BAFF is a ligand bound complex. The L45-BAFF-28 CAR was able to lyse MM1S tumor cells after 48 hours at an E:T ratio of 3:1 approaching 60% (FIG. 46). Furthermore, the L8-BAFF-28 IL-15/IL-15sushi and L8-BAFF-28 4-1BBL CARs were also able to achieve comparable degrees of cytotoxicity (FIG. 47A, 47B). Co-culture with the B cell mantle cell line SP53 show a limited effect with around 25% cytotoxicity observed for the L8-BAFF-28 IL-15/IL-15 CAR only (FIG. 47).

CD45 CAR Therapy

Three pairs of sgRNA are designed with CHOPCHOP to target the gene of interest. Gene-specific sgRNAs are then cloned into the lentiviral vector (Lenti U6-sgRNA-SFFV-Cas9-puro-wpre) expressing a human Cas9 and puromycin resistance genes linked with an E2A self-cleaving linker. The U6-sgRNA cassette is in front of the Cas9 element. The expression of sgRNA and Cas9puro is driven by the U6 promoter and SFFV promoter, respectively (FIG. 48).

The following gene-specific sgRNA sequences were used and constructed,

In a non-limiting embodiment of the disclosure, exemplary gene-specific sgRNAs have been designed and constructed as set forth below:

CD45 sgRNA Construct:

```
Lenti-U6-sgCD45a-SFFV-Cas9-puro
GTGGTGTGAGTAGGTAA

Lenti-U6-sgCD45b-SFFV-Cas9-puro
GAGTTTTGCATTGGCGG

Lenti-U6-sgCD45c-SFFV-Cas9-puro
GAGGGTGGTTGTCAATG
```

FIG. 49A shows steps of generation of CD45 CAR T or NK cell targeting hematologic malignancies.

CRISPR/Cas Nucleases Target to CD45 on NK Cells

Lentiviruses carried gene-specific sgRNAs were used to transduce NK-92 cells. The loss of CD45 expression on NK-92 cells was determined by flow cytometry analysis. The CD45 negative population of NK-92 cells was sorted and expanded (FIG. 49B). The sorted and expanded CD45 negative NK-92 cells were used to generate CD45CAR NK cells. The resulting CD45CAR NK cells were used to test their ability of killing CD45+ cells.

Functional Characterization of CD45 Inactivated NK-92 Cells ($NK^{45i}$-92) after CRISPR/Cas Nucleases Target We demonstrated that, following CRISPR/Cas nuclease inactivation of CD45, the growth of $NK^{45i}$-92 cells was similar to that of the wild NK-92 cells (FIG. 50). Inactivation of CD45 did not significantly affect the cell proliferation of NK-92. In addition, we showed that the lysis ability of $NK^{45i}$-92 cells was compatible to that of wild type, NK-92 when cells were co-cultured with leukemic cells, CCRF (FIG. 51).

To demonstrate that CD45-inactivated NK-92 was compatible with CAR lysis, $NK^{45i}$-92 cells and their wild type, NK-92 were transduced with lentiviruses expressing CD5CAR or GFP. The resulting CD5CAR $NK^{45i}$-92 cells and GFP $NK^{45i}$-92 were sorted by FACS, and used to compare their ability of killing targeted cells. CD5CAR $NK^{45i}$-92 cells displayed the ability of robustly killing CD5 target leukemic cells at ratios (E:T), 2:1 and 5:1 when they were co-cultured with CCRF-CEM cells. We showed that there was a similar efficacy of elimination of CCRF-CEM cells in vitro between CD5CAR $NK^{45i}$-92 and CD5 CAR NK-92 cells (FIG. 52). This suggests that the loss of CD45 expression does not diminish the anti-tumor activity of CAR NK-cells.

Generation of CD45CAR Construct

We next investigate that CD45CAR in $NK^{45i}$-92 cells response to the CD45 antigen in leukemic cells. We generated CD45CAR. CD45CAR consists of an anti-CD45 single-chain variable fragment (scFv) region, CD8-derived hinge (H) and transmembrane (TM) regions, and tandem CD28 and 4-1BB co-activation domains linked to the CD3ζ signaling domain (FIG. 53A). A strong spleen focus forming virus promoter (SFFV) and a CD8 leader sequence were used. CD45CAR protein was characterized by Western blot of HEK293-FT cells transfected with CD45CAR lentiviral plasmid with appropriate vector control. Additionally, anti-CD3zeta monoclonal antibody immunoblots revealed bands of predicted size for the CD45CAR protein with no bands observed in vector control (FIG. 53B).

CD45CAR $NK^{45i}$-92 NK Cells

Following fluorescence-activated cell sorting (FACS) to enrich for $NK^{45i}$-92 cells, CD45CAR NK-92 transduction efficiency was determined to be 87%, as determined by flow cytometry (FIG. 54) after sorting. After FACS collection of $NK^{45i}$-92 cells, CD45CAR expression levels remained consistently stable for at least 10 passages.

CD45CAR $NK^{45i}$-92 Cells Specifically Lyse CD45+ Leukemic Cells.

To assess CD45CAR $NK^{45i}$-92 anti-leukemic activity, we conducted co-culture assays using T-ALL cell lines, CCRF-CEM and Jurkat, and NK cell line and NK-92 cells since they all express CD45 (FIGS. 55, 56 and 57). We demonstrated that CD45CAR $NK^{45i}$-92 cells consistently displayed robust lysis of leukemic cells. Following 6-hour incubation at a low effective to target cell (E:T ratio 5:1), CD45CAR $NK^{45i}$-92 cells effectively lysed more than 60% of CCRF-CEM cells (FIG. 55). After 6-hour co-culture, CD45CAR $NK^{45i}$-92 cells were also able to eliminate about 60% of Jurkat cells at a ratio of E:T, 2:1 or 5:1(FIG. 56). After 6 hours of co-culture, CD45CAR $NK^{45i}$-92 cells efficiently lysed 20% CD45 positive NK-92 cells at an E:T ratio of 2:1, with close to 60% lysis at an E:T of 5:1 (FIGS. 57A-57C).

To further analyze the CD45 target for hematologic malignancies, we also generated additional two CARs: CD45-28 and CD45-BB, and the lentiviruses expressing CD45-28 or CD45-BB CAR were used to transduce NK45i-92 cells. CD45-28 and CD45-BB CARs contain a new anti-CD45 scFv, which is different from that of CD45CAR described herein and above. CD45-28 CAR uses a CD28 co-stimulatory domain while the CD45-BB bears a 4-BB co-stimulatory domain. Both CARs use the CD8-derived hinge (H), transmembrane (TM) regions and CD3ζ signaling domain. CD45CARs displayed robust lysis of B acute lymphoblastic cell line, REH. CD45CAR NK45i-92 cells lysed about 76% REH cells. CD45b-BB CAR NK45i-92 cells and CD45b-28 CAR NK45i-92 cells showed about 79% and 100% lysis of REH cells, respectively compared to control GFP NK-92 cells (FIG. 57D-57E). CD45b-28 CAR NK45i-92 cells exhibited the highest ability of lysis of REH cells (B-ALL cells).

We also investigated if CD4b-28CAR CD45b-28 CAR NK45i-92 cells could lyse other types of leukemic cells. As shown in FIG. 57F, co-culture assay was performed with U937 cells (target: T) and GFP NK-92 cells or CD45b-28 $NK^{45i}$-92 cells (effector: E) at 2:1 (E:T) ratio for 20 hours, CD45b-28 $NK^{45i}$-92 cells exhibited a robust anti-leukemic activity with about 81% cell lysis against U937 cells compared to control GFP NK-92 cells. U937 is an acute myeloid leukemia cell line. A similar finding was seen when co-culture assay was done with MOLM-13 cells (target: T) and GFP NK-92 cells or CD45b-28 NK45i-92 cells (effector: E) at 5:1 (E:T) ratio for 20 hours (FIG. 57G). MOLM-13 cells are derived from a patient with aggressive acute monocytic leukemia. The anti-leukemic activities were also examined in two mantle cell lines, SP53 and Jeko (FIGS. 57H and I). CD45b-28 $NK^{45i}$-92 with a low ratio of 2:1(E:T), were able to lyse more than 40% of SP53 cells or Jeko leukemic cells compared to control GFP NK-92 cells at a relative short co-culture period of time, 6 hours. These studies demonstrated that CD45b-28 $NK^{45i}$-92 had a remarkable anti-leukemic property against different types of malignant leukemias.

We further investigated if CD45b-28 $NK^{45i}$-92 cells could lyse CD34+ hematopoietic stem/progenitor cells. CD34(+) stem cells derived from human umbilical cord blood were co-cultured with either control or CD45b-28 CAR NK cells for 48 hr at a low ratio of 2:1 (effective: target). CD45b-28 $NK^{45i}$-92 cells nearly eliminate CD34+ hematopoietic precursor cells (FIG. 57J) compared to the control.

An Alternative CAR Design to Enhance CD45 CAR Activity

We also generated engineered CD45 CAR cells received not only costimulation through the CD28 but also co-express the 4-1BB ligand (4-1BBL or CD137L) in a single construct, which provide the better therapeutic efficacy (FIG. 58A) and their example is described below:

Example: CD45b-28-2G-4-1BBL was generated and the generated CD45b CAR cells could receive both co-stimulatory pathways, CD28 and 4-1BB. CD45b-28-2G-4-1BBL viruses were concentrated by 4 fold and used to transduce $NK^{45i}$-92 cells. Its CAR surface expression was about 87% (FIG. 58B). CD45b-28-2G-4-1BBL viruses were concentrated by 4 fold and used for transduction. Anti-tumor activity of CD45b-2G CAR cells was significantly improved when 4-1BBL was included in the construct.

An enhancer, IL-15/IL-15sushi was also included in CD45 CAR construct as an alternative approach to enhance CD45 CAR anti-tumor activity. Both CD45 CAR and IL-15/IL-15sushi were in a single construct (FIG. 58). Anti-tumor activity of CD45b-2G CAR cells is significantly improved when IL-15/IL-15sushi is included in the construct.

Example: CD45b-28-2G-IL-15/IL-15sushi NK cells was generated. Surface CD45b CAR expression were about 60%. (FIG. 58C). Anti-tumor activity of CD45b-2G CAR cells was significantly improved when IL-15/IL-15sushi was included in the construct.

Characterization of CD4IL-15/IL-15sushi CAR

The CD4IL-15/IL-15sushi-CAR has been generated and it contains the third generation of CD4CAR linked to IL-15/IL-15sushi (FIG. 59). A combination of CAR, (third generation), sushi/IL-15 is assembled on an expression vector and their expression is driven by the SFFV promoter (FIG. 59). CAR with IL-15/IL-15sushi is linked with the P2A cleaving sequence. The IL-15/IL-15sushi portion is composed of IL-2 signal peptide fused to IL-15 linked to IL-15susi via a 26-amino acid poly-proline linker (FIG. 59). The IL-2 signal peptide provides a better secreting signal. The stable, functional complexes of IL-15/IL-15sushi can be secreted from the transduced cells and the secretion is directed by IL-2 signal peptide.

To verify the CD4IL-15/IL-15sushi construct, HEK293FT cells were transfected with lentiviral plasmids for either GFP (control) or. CD4IL-15/IL-15sushi. Approximately 60 hours after transfection, both HEK-293FT cells and supernatant were collected. Cells were lysed in RIPA buffer containing protease inhibitor cocktail and electrophoresed. The gel was transferred to Immobilon FL blotting membrane, blocked, and probed with mouse anti-human CD3z antibody at 1:500. After washes, membrane was probed with goat anti-mouse HRP conjugate, washed, and exposed to film following treatment with HyGlo HRP substrate. The CD4IL-15/IL-15sushi was successfully expressed in HEK 293 cells (Lane 2, FIG. 60a). The CD4IL-15/IL-15sushi lentiviral supernatant was further examined by the transduction of fresh HEK-293 cells (FIG. 60A). HEK-293 cells were transduced with either GFP or CD4IL-15/IL-15sushi CAR viral supernatant from transfected HEK-293FT cells. Polybrene was added to 4 µL/mL. Media was changed after 16 hours and replaced with media containing no viral supernatant or polybrene. Three days after transduction, cells were harvested and stained with goat-anti-mouse F(Ab')2 antibody at 1:250 for 30 minutes. Cells were washed and stained with streptavidin-PE conjugate at 1:500, washed, suspended in 2% formalin, and analyzed by flow cytometry. FIG. 60b shows that HEK-293 cells that were transduced with the CD4IL-15/IL-15sushi CAR lentivirus were 80% positive for F(Ab)2-PE (circled, FIG. 60B), while transduction with GFP control lentivirus was minimal for F(Ab)2-PE (FIG. 60).

Production of CD4IL-15/IL-15sushi-CAR NK Cells

NK-92 cells were transduced with concentrated CD4IL-15/IL-15sushi-CAR lentiviral supernatant. After 5 days incubation, cells were harvested and incubated with goat anti-mouse F(Ab')2 at 1:250 for 30 minutes. Cells were washed, suspended and stained with streptavidin-PE for 30 minutes. Cells were washed and suspended in 2% formalin, and analyzed by flow cytometry, resulting in nearly 70% of the transduced cells expressing CD4IL-15/IL-15sushi-CAR (circled, FIG. 61. Further experimental tests for CD4IL-15/IL-15sushi-CAR included leukemia/lymphoma killing assays in vitro and vivo, and comparison of target killing and proliferation rates with cells transduced with CD4CAR. The same strategy described herein was used to generate CD19IL-15/IL-15sush CAR, CD20IL-15/IL-15sush CAR and CD22IL-15/IL-15sush CAR.

Production of CD4IL-15/IL-15sushi-CAR T Cells

Human umbilical cord buffy coat cells were transduced with concentrated CD4IL-15/IL-15sushi-CAR lentiviral supernatant. After 5 days incubation, cells were harvested and incubated with goat anti-mouse F(Ab')2 at 1:250 for 30 minutes. Cells were washed, suspended and stained with streptavidin-PE for 30 minutes. Cells were washed and suspended in 2% formalin, and analyzed by flow cytometry, resulting in 63% of the transduced cells expressing CD4IL-15/IL-15sushi-CAR (circled, FIG. 62). Further experimental tests for CD4IL-15/IL-15sushi-CAR will include leukemia/lymphoma killing assays in vitro and vivo, and comparison of target killing and proliferation rates with cells transduced with CD4CAR.

CD4IL-15/IL-15sushi CAR NK Cells were Tested for Anti-Leukemic Activity Relative to CD4CAR NK Cells In Vitro by Co-Culturing them with the Following CD4 Positive Cell Lines: Karpas 299 and MOLT4.

The Karpas 299 cell line was derived from a patient with anaplastic large T cell lymphoma. The MOLT4 cell line expressing CD4 was established from the peripheral blood of a 19-year-old patient with acute lymphoblastic leukemia (T-ALL). During 4-hour co-culture experiments, CD4IL-15/IL-15sushi CAR NK cells showed profound killing (95%) of Karpas 299 cells at a 5:1 ratio of effector:target, at an even higher rate than that of CD4CAR NK cells (82%; FIG. 63). Similarly, when co-cultured 1:1 with MOLT4 cells, CD4IL-15/IL-15sushi CAR NK cells lysed target cells at a higher rate (84% to 65%) than CD4CAR NK cells in an overnight assay (FIG. 64). These results show that CD4IL-15/sushi CAR NK cells can ablate tumor cells.

Both CD4CAR and CD4IL-15/IL-15sushi CAR T Cells Exhibit Significant Anti-Tumor Activity In Vivo In order to evaluate the in vivo anti-tumor activity of CD4CAR and CD4IL-15/IL-15sushi CAR T cells, and to determine the possible increase in persistence of the CD4IL-15/IL-15sushi CAR T cells relative to the CD4CAR T cells, we developed a xenogeneic mouse model using NSG mice sublethally irradiated and intravenously injected with luciferase-expressing MOLM13 cells, an acute myeloid leukemia cell line that is 100% CD4+, to induce measurable tumor formation (FIG. 65). Three days following tumor cell injection, 6 mice each were intravenously injected with a course of $8 \times 10^6$ CD4CAR, CD4IL-15/IL-15sushi T cells or vector control T cells. On days 3, 6, 9 and 11, mice were injected subcutaneously with RediJect D-Luciferin (Perkin Elmer) and subjected to IVIS imaging to measure tumor burden (FIG. 65B). Average light intensity measured for the CD4CAR and CD4IL-15/IL-15sushi CAR T cell injected mice was compared to that of vector control T cell injected mice in order to determine the percentage of tumor cells in treated versus control mice (FIG. 65C). CD4CAR T cell-treated mice had a 52% lower tumor burden relative to control on Day 6, whereas CD4IL-15/IL-15sushi CAR T cell-treated mice had a 74% lower tumor burden. On Day 11, nearly all tumor cells had been lysed in both of these groups. Unpaired T test analysis revealed a very significant difference (P=0.0045) between control and the two groups by day 9 with less light intensity and thus less tumor burden in the CD4CAR and CD4IL-15/IL-15sushi CAR T cells treated group compared to control. In summary, these in vivo data indicate that CD4CAR and CD4IL-15/IL-15sushi CAR T cells both significantly reduce tumor burden and in MOLM13-injected NSG mice when compared to vector control T cells.

Next, we compared mouse survival across the two groups (FIG. 65D). All leukemic mice injected with CD4IL-15/IL-15sushi CAR T cell survived longer than that of CD4CAR T cells. In summary, these in vivo data indicate that CD4IL-15/IL-15sushi CAR T cells significantly reduce tumor burden and prolong survival in CD4IL-15/IL-15sush CAR T-injected NSG mice when compared to control cells.

CD4IL-15/IL-15sushi CAR NK Cells Exhibit Robust and Persistent Anti-Tumor Activity In Vivo In order to further evaluate the CD4IL-15/IL-15sushi CAR function, we created a stressful condition utilizing NK CAR cells and Jurkat tumor cells. The NK cells bear a short half-life property and leukemic Jurkat cells show less than 60% CD4+ phenotype (FIG. 66A). In such a condition, it allows us to investigate how secretory soluble IL-15sushi affects the CAR functions in terms of its persistence and killing capability. We then used our xenogeneic NSG mouse model using NSG mice sublethally irradiated and intravenously injected with luciferase-expressing Jurkat cells to induce measurable tumor formation. In contrast with MOLM-13 cells, Jurkat cells show less than 60% CD4+ phenotype (FIG. 66A). Three days following Jurkat cell injection, mice were intravenously injected with a course of $10 \times 10^6$ either CD4CAR, CD4IL-15/IL-15sushi, or vector control NK cells. On day 3 (the day before treatment), 7, 10, and 14, mice were subjected to IVIS imaging to measure tumor burden (FIG. 66B). Average light intensity measured for the CD4CAR and CD4IL-15/IL-15sushi NK injected mice was compared to that of vector control NK injected mice to determine percent lysis of Jurkat cells (FIG. 66C). Although both conditions showed significant tumor cell lysis by Day 7, lysis percentage for CD4CAR NK cells stayed the same to Day 14 while CD4IL-15/IL-15sushi NK cells increased to over 97%. (FIG. 66D). Unpaired T test analysis revealed an extremely significant difference (P<0.0001) between the two groups by Day 14. These results indicate that CD4CAR NK cell lysis of Jurkat tumor cells was not able to keep up with the expansion of CD4– Jurkat cells, whereas the continued expansion of NK CAR cells secreting IL-15/IL-15sushi effectively lysed. The co-expression of secretory IL-15/IL-15sushi with CAR could supplement the defect that CAR T or NK cells are unable to eliminate dim expressed cancer cells or non-targeting cancer cells. A repeat of experiments (FIG. 67) showed similar results to those described in FIG. 66.

Secreted IL-15/IL-15sushi Substitutes for IL-2 in NK Cell Survival and Expansion.

The effect of IL-15/IL-15sushi-secreting NK cells on cell survival was determined. NK-92 cells stably transduced with either CD4CAR or CD4IL-15/IL-15sushi were cultured in the presence or absence of IL-2 to determine if IL-15/IL-15sushi secretion alone could lead to survival and expansion. CD4CAR-expressing NK cells cultured without IL-2 died by Day 7, while CD4IL-15/IL-15sushi-expressing NK cells cultured without IL-2 expanded at approximately the same rate as either CD4CAR or CD4IL-15/IL-15sushi cells cultured with IL-2 (FIGS. 68A and 68B), showing that secreted IL-15/IL-15sushi could substitute for IL-2. Furthermore, we were able to demonstrate that NK cells secreting IL-15/IL-15sushi could aid in the survival and expansion of non-transduced NK-92 cells in a co-culture. In this experiment, an equal ratio of NK GFP-expressing cells were cultured with either CD4CAR- or CD4IL-15/IL-15sushi-expressing NK cells, in the presence or absence of IL-2. Cells were counted every 2-3 days (FIG. 68A). By Day 7, CD4CAR NK cells given no IL-2 had died, but CD4IL-15/IL-15sushi NK cells without IL-2 had survived and expanded at approximately the same rate as either CD4CAR or CD4IL-15/IL-15sushi cells cultured with IL-2. The number of GFP-expressing cells had risen along with the CD4IL-15/IL-15sushi NK cells (FIG. 68B), indicating that the secreted IL-15/IL-15sushi had positively affected GFP NK cell survival. The percentage of GFP-positive cells had risen from 50% to over 70% over the course of the experiment (data not shown). In the second experiment (FIG. 69), we compared the effect of secreted IL-15 and IL-15/IL-15sushi on NK-92 cell growth. CD4IL-15/IL-15sushi, CD4 IL-15, and control transduced NK-92 cells were cultured from 250,000 cells in regular NK cell media but in the absence of IL-2 for up to 6 days. Both transduced cells had 10% surface CAR expression, while CD4IL15-IL15sushi transduced NK-92 cells were able to expand at a rate approximately 3-fold higher than the CD4 IL-15 transduced NK-92 cells on day 6. On day 4, the growth rate of CD4 IL-15 transduced NK-92 cells were slightly higher than the Control, but significantly below the CD4 IL-15/IL15sushi transduced NK-92 cells.

To further determine if this effect was due to secreted protein alone, or an interaction between co-cultured cells, we devised an experiment in which the GFP NK cells were cultured in a chamber above the cultured CD4CAR or CD4IL-15/IL-15sushi NK cells, or non-transduced NK-92 cells. In this situation, only proteins and not cells could pass between the membrane separating the two cultures. Cells were incubated without IL-2, counted and split 1:1 every other day. While GFP NK cells in the upper chamber above NK-92 cells had died by Day 6, the GFP NK cells above the CD4IL-15/IL-15sushi NK cells had survived and expanded by Day 12, thereby indicating that it was the IL-15/IL-15sushi protein secreted by the CD4IL-15/IL-15sushi NK cells which had kept them alive, and not direct cell-to-cell contact. In this model, the upper chamber represents the tumor microenvironment, in which the survival of T cells or NK cells is improved by the secretion of IL-15/IL-15sushi from the CD4IL-15/IL-15sushi NK cells.

Effect of Secreted IL-15/IL-15sushi on CAR T and Non-Transduced Neighboring Cells.

We also compared the cell growth of CD4CAR and CD4IL-15/IL-15sushi transduced T cells in the presence or absence of IL-2. Total cell counts calculated throughout the experiment (up to Day 17) for transduced cells with or without IL-2. CD4IL-15/IL-15sushi transduced T cells appeared to be more tolerant to the absence of IL-2 than that of CD4CAR transduced T cells.

Examples

Generation of Treg CAR Target Treg Cells

Treg CAR (also called CD4zetaCD25CAR or C4-25z) followed the schematic in FIG. 70. It comprises of SFFV (spleen focus-forming virus) promoter that drives the expression of two different units of incomplete CARs linked by a P2A cleavage peptide. The CD4 chimeric antigen receptor polypeptide unit comprises a CD45 signal peptide, a CD4 antigen recognition domain, a hinge region (derived CD8a), a transmembrane domain (CD8a) and CD3 zeta chain; CD25 chimeric antigen receptor polypeptide unit comprises a CD45 signal peptide, a CD25 antigen recognition domain, a hinge region (CD8a), a transmembrane domain (CD8a), a co-stimulatory domain (s), CD28. The Treg CAR can potentiate the lysis activity of a cell co-expressing CD4 and CD25 while minimizing a cell bearing CD4 or CD25 antigen alone.

The CD4zetaCD25CAR (C4-25z) (Treg CAR) was transduced in an assay. Compared to control T-cells, CD4zetaCD25CAR cells show ~15% surface expression and this was sufficient to observe the following phenotype validation of construct function (FIG. 70A). CD4zetaCD25 CAR cells and control T-cells were both assayed with CD4 and CD25 antibody to look for logic gated behavior using flow cytometry analysis. Due to the construct design, the CD4zetaCD25CAR cell would potentiate the lysis activity for cells co-expressing both CD4 and CD25 antigens. Here, we showed depletion (~95%) of the CD4+CD25+ double positive population with little impact of off-logic events in the other phenotype cases.

We further characterized CD4zetaCD25 CAR by comparing it with CD4 CAR. As expected, CD4CAR T cells had a profound lysis ability of cells expressing CD4 only while CD4zetaCD25CAR T cells had a limited killing ability on this population (FIG. 71). CD4zetaCD25CAR T cells also showed virtually complete depletion of cells expressing both CD4 and CD25 antigens (FIG. 71). A bar graph summary shows that the logic gated CAR construct design only significantly impacts the double positive population (FIG. 71B). As shown in FIG. 72, CD4CAR T cells virtually deleted all cells expressing CD4 while CD4zetaCD25 CAR T cells mainly eliminate cells co-expressing CD4 and CD25. These studies demonstrate that the robust CD4zetaCD25CAR targeting cells co-expressing both CD4 and CD25, has been established. Due to human-specific CD4 or CD25scFv in the construct, the functional properties of CD4zetaCD25CAR are difficult to test in animals.

In some embodiments, the disclosed disclosure also comprises methods of improving the CD4zetaCD25CAR therapeutic activity. The example is described below.

Example

An engineered CD4zetaCD25CAR cell was prepared in accordance with the present disclosure.

Cell Killing Assay is Performed

Targeted Cells killing by CD4zetaCD25CAR is improved when co-expressed with 4-1BBL or IL-15/IL-15sushi or IL-15/IL-15RA.

Safety Switch

Introduction of a "safety switch" greatly increases safety profile and the "safety switch" may be an inducible suicide gene, such as, without limiting, caspase 9 gene, thymidine kinase, cytosine deaminase (CD) or cytochrome P450. Other safety switches for elimination of unwanted modified T cells involve co-expression of CD20 or CD52 or CD19 or truncated epidermal growth factor receptor in T cells.

Example: Co-Expression of Cd52 with Cars Using Cd5Car Targeting T-Cell Malignancies as an Example For clinical treatment using CAR T-cells against T-cell malignancies, establishment of safety methods to eliminate CAR T-cells from patients may be necessary after tumor depletion or in emergency cases due to unexpected side effects caused by CAR therapy. T-cells and B-cells express CD52 on the cell surface and a CD52 specific antibody, CAMPATH (alemtuzumab), can eliminate CD52+ cells from circulation. We thus incorporated a human CD52 sequence into the CD5CAR vector construct (FIG. 73A). This additional CD52 construct mechanically separates the signaling from native CD52. The aim was to preempt the possibility of native CD52 antigen escape on CAR T-cell surface after CAMPATH treatment. CD5CAR-CD52 lentiviral protein and expression were confirmed via western blot and flow cytometry analysis using CD52 antibody on transduced HEK293 cells. We also found that co-expressing CD52 would not affect the CAR T cell functions.

In Vivo Depletion of Infused CD5CAR-CD52 T Cells Following Treatment with CAMPATH To assess the effect of CAR elimination by CAMPATH (alemtuzumab) treatment, we conducted in vivo procedures as described (FIG. 73B). We intravenously injected $5\times10^6$ CD5CAR-52 T-cells into irradiated mice. Next day, we added 0.1 mg/kg of CAMPATH or PBS via IP injection for 3 mice of each group. After 6 and 24 hours following CAMPATH treatment, we collected peripheral blood from the mouse tail and determined presence of CD5CAR-52 T-cells by FACS analysis. CAMPATH injection virtually completely depletes CD5CAR-CD52 T-cells in blood at both 6 h and 24 h (FIG. 73C). Five days following CAMPATH administration, CD5CAR-CD52 cells were also completely depleted in both the bone marrow and spleen (FIG. 73D). These findings support the use of CAMPATH as a useful strategy in acting as a safety trigger to deplete CAR-T cells from circulation and lymphoid organs.

In one embodiment, the engineered cell includes a CD5 chimeric antigen receptor polypeptide and an anchor CD52 (SEQ ID NO. 70), and corresponding polynucleotide (SEQ ID NO. 69). In some embodiments, CD52 is incorporated into CD5 CAR engineered cell or any CAR engineered cell and can be used as a "safety switch" for CAR therapy.

Promoter Testing Using the GFP Reporter

HEK293FT cells were transfected with lentiviral plasmids expressing GFP under the SFFV, EF1 or CAG promoters. Approximately 60 hours after transfection, supernatant was collected from each. Relative viral titer was determined by first transducing HEK293 cells with supernatant from each of the 3 promoters. HEK-293 cells were transduced with GFP viral supernatant from each of the 3 transfected HEK-293FT cells. Polybrene was added to 4 µL/mL. Media was changed after 16 hours and replaced with media containing no viral supernatant or polybrene. Three days after transduction, cells were harvested and washed, suspended in 2% formalin, and analyzed by flow cytometry for GFP expression (FITC). GFP expression was seen in each sample, but was highest for the cells transduced with virus made using the SFFV promoter.

Activated human umbilical cord buffy coat cells were transduced with GFP lentiviral supernatant (amount based on the results of the HEK293 transduction efficiency) from each of the promoters. After 5 days incubation, cells were harvested, washed and suspended in 2% formalin, and analyzed by flow cytometry for GFP expression. 43% of cells expressed GFP at high levels ($>10^3$) while GFP-expression for cells transduced with virus using promoters EF1 (15%) and CAG (3%) were considerably lower. Five days later, cells analyzed the same way showed nearly the same percentages for each (46%, 15% and 3%, respectively). These results indicate that SFFV promoter leads to stronger expression than EF1 or CAG promoters, and that the expression remains high for at least 10 days post-transduction. Further experimental tests will include longer incubation times for transduced cells beyond the 10-day window.

Functional Titer of Viral Vector Particles in Supernatants (the % GFP Cells as Determined by Flow Cytometry Allows for Proxy Viral Titer Adjustments as Higher Titer Virus Infiltrates More Cells, Leading to Higher % GFP Cell Populations).

To determine functional titer of viral vector particles in each of our supernatants, HEK 293 cells were transduced with either EF1-GFP or SFFV-GFP viral supernatant, with either 30 L (low), 125 µL (medium), or 500 µL (high) per well of a 12 well tissue-culture treated plate. Culture media was changed the following morning to DMEM plus 10% FBS (FIG. 74).

Transduced cells were then trypsinized, washed, and suspended in formalin and subjected to flow analysis. The percentage of GFP+ cells in each of the conditions was determined by flow cytometry using the FITC channel (FIG. 75). In each case, the percentage of GFP+ was higher in cells transduced with SFFV-GFP than the cells transduced with the corresponding volume of EF1-GFP viral supernatant (50% to 18% for low, 80% to 40% for medium, and 82% to 70% for high). From this, we determined that using the highest volume of EF1-promoter virus was comparable to using the lowest volume of SFFV-promoter virus in terms of titer, and would allow for comparison of relative promoter strengths for the following transduction experiments Transduced cells were also visualized on an EVOS fluorescent microscope using GFP at 20× at the same exposure conditions for each well (FIG. 74). Cells transduced with SFFV-GFP viral supernatant were dramatically brighter than cells transduced with EF1-GFP. Furthermore, comparing the image of the EF1-promoter under high viral volume loads with the image of the SFFV-promoter using low viral volume loads show similar fluorescent intensity. This suggests that the SFFV promoter is a stronger driver of gene expression.

Comparison of Surface Expression and Persistence of Different Promoters in Primary T-Cells (the % GFP Cells as Determined by Flow Cytometry for T-Cell Transductions Show Expected Differences in GFP Cell Populations as Expected from the Prior Experiments on HEK293 Cells)

To determine promoter transduction efficiency and persistence of surface expression in primary T cells, activated cord blood buffy coat T cells were transduced with either 50 µL of SFFV-GFP or 1 mL of EF1-GFP EF1-GFP viral supernatant, in 12-well tissue culture-treated plates pre-coated with retronectin (Clontech). Following two overnight transductions, cells were cultured on T cell media with 300 IU/mL IL-2 (Peprotech) and maintained at $1.0$-$4.0\times10^6$/mL. Cells were washed, suspended in formalin, and subjected to flow cytometry analysis, using the FITC channel to determine the percentage of GFP+ cells, on 7, 14, 21 and 28 days after transduction. The percentage of GFP+ cells was consistently higher for T cells transduced with SFFV-GFP compared to EF1-GFP-transduced T cells (FIG. 76A), even as the percentage of total GFP+ cells decreased over this period. A further comparison showed that T cells transduced with the higher (1 mL) amount of EF1-GFP supernatant actually decreased in percentage relative to the percent of GFP+ cells transduced with the lower amount (50 µL, or 20-fold less) of SFFV-GFP, between Day 7 and Day 28, from over 60% to under 40% (FIG. 76B). This suggests that transduction using the SFFV promoter led to greater persistence of transduced cells.

Methods of generating the CAR gene including at least one of a T antigen recognition moiety (at least one of CD4, CD8, CD3, CD5, CD7, and CD2, or a part or a combination thereof), a hinge region and T-cell activation domains is provided.

Methods of generating multiple units of CARs (cCAR) targeting antigen (s) including at least one of CD33, CD123, CD19, CD20, CD22, CD269, CS1, CD38, CD52, ROR1, PSMA, BAFF, TACI, CD138, and GPC3, or a part or a combination of a hinge region and T-cell activation domains is provided.

The provided methods also include: 1) generating of the CAR T or NK cells targeting leukemias and lymphomas expressing CD45 and avoiding self-killing; 2) generation of "armored" CAR T or NK cells designed to both overcome the inhibitory tumor microenvironment and exhibit enhanced anti-tumor activity and long-term persistence.

CAR Therapy for Asthma

A CAR Design for Targeting IgE Producing Cells.

We designed a ligand expressing CAR that binds to IgE producing cells. As shown in FIG. 82A, IgE releases from plasma cells and binds to a FceR1A receptor complex present in the mast cells, basophil or eosinophil, which triggers the release of allergic mediators. A CAR can be designed to target or delete the Ig E producing plasma cells and basophils or eosinophils responsible for allergic mediator release. We designed a FcER1A CAR (FIG. 82B) targeting IgE producing plasma cells. The FcER1A CAR construct is a modularized signaling domain containing: a leader sequence, an extracellular domain of FcER1A, a hinge domain (H), a transmembrane domain (TM), a co-stimulatory domains (CD28) and the intracellular signaling domain CD3 zeta. Functional equivalents also include extracellular domain of FcER1A from homologous proteins from other species shown in FIG. 82C.

We characterized the biological properties of FcER1A CAR by a co-culture assay with a IgE producing plasma cell line, U266. Control and FcER1A CAR T-cells were incubated with a myeloma cell line, U266 (prestained with Celltracker CMTMR) at an E:T ratio of 5:1. FcER1A CAR were able to lyse U266 approaching 60% (FIG. 82D).

In one embodiment, an engineered cell includes a FcER1A CAR composing of a receptor polypeptide having a IgE recognition domain. In one embodiment, this engineered cell includes a polypeptide of SEQ ID NO. 168, and corresponding polynucleotide of SEQ ID NO. 169.

In some embodiments, the disclosed disclosure also comprises methods of improving the FcER1A CAR therapeutic activity. The example is described below.

Example

An engineered FcER1A CAR cell was prepared in accordance with the present disclosure.

Cell Killing Assay is Performed

Targeted Cells killing by FcER1A CAR is improved when co-expressed with 4-1BBL or IL-15/IL-15 sushi or IL-15/IL-15RA or IL-15/IL-15sushi anchor.

In particular embodiments, the engineered cell includes FcER1A CAR linked to 4-1BBL via the P2A cleavage sequence. A polypeptide providing this embodiment includes SEQ ID No. 170 and corresponding polynucleotide sequence SEQ ID No. 171.

In some embodiments, the disclosed disclosure also comprises methods of deleting mast cells, basophils or eosinophils that bear FceR1A receptor complexes using anti-FcER1 CAR (FIG. 82E). The anti-FcER1 CAR construct is a modularized signaling domain containing: a leader sequence, an scFv against extracellular domains of FceR1A receptor complexes, a hinge domain (H), a transmembrane domain (TM), a co-stimulatory domains (CD28) and the intracellular signaling domain CD3 zeta.

The example is described below.

Example

An engineered anti-FcER1 CAR cell was prepared in accordance with the present disclosure.

Cell killing assay is performed and targeted Cells are lysed by anti-FcER1 CAR.

Generation and Characterization of CD19b-Cd123 cCAR Constructs

As stated herein, the choice of promoter and leader sequences are important factors to consider for CAR surface expression level when designing CARs; so is the scFv antibody sequence. When designing longer gene constructs, the level of protein expression drops significantly with each 1 kb of additional length. The goal is to achieve the highest possible level of surface expression for single CARs, so that when combined into the much longer compound CAR, expression remains high, and tumor lysing activity also remains high. To determine a higher CAR percentage, we designed a new antibody scFv sequence for CD19 (CD19b) to improve surface expression and activity. The compound CAR CD19bCD123-2G was constructed as shown in the diagram in FIG. 83A.

FIG. 83B shows the transduction efficiency between activated T cells transduced with either control vector or CD19bCD123-2G CAR vector, as determined by labeling with goat anti-mouse F(Ab')2 antibody. Activated T cells transduced with the CAR vector resulted in 26% F(Ab')2 positive cells.

CD19bCD123-2G CAR T Cells Efficiently Lyse Human Tumor Cell Lines in In Vitro Assays.

The CD19bCD123-2G CAR T cells were assayed for their ability to lyse various tumor cell lines. The results are summarized in FIG. 83C-E.

CD19bCD123-2G CAR T cells or control T cells were co-cultured with either KG1-a human acute myeloid leukemia cells (CD123+), K562 human chronic myeloid leukemia cells synthetically expressing the CD19 antigen (called K-19), or SP53 human mantle cell lymphoma cells (CD19+), for 16 or 48 hours at E:T ratio of 5:1. After 16 and 48 hours, cells were stained with mouse anti-human CD3, and either CD19, or CD123 and analyzed by flow cytometry. CD19bCD123-2G CAR T cells were able to lyse 69% and 93% of the CD123+KG1-a cells after 16 and 48 hours, respectively (FIG. 83C). The CD19bCD123-2G CAR T cells lysed a similar percentage of the CD19-expressing K562 cells (66% and 98%) at the same time points (FIG. 83D). Killing efficiency was even stronger against the SP53 (CD19+) cell line, with 86% of target cells ablated after just 16 hours (FIG. 83E). These results show that both the CD19b and CD123 domains of the CAR are able to specifically lyse target cells with equal or similar high efficiency.

CD19bCD123-2G CAR T Cells Exhibit Significant Anti-Tumor Activity in Xenogeneic Mouse Model.

In order to evaluate the in vivo anti-tumor activity of CD19bCD123-2G (also called CD19b-CD123) CAR T cells against MOLM13 tumor cell line, we developed a xenogeneic mouse model using NSG mice sublethally irradiated and intravenously injected with luciferase-expressing MOLM13 cells to induce measurable tumor formation. MOLM13 leukemic cell line is derived from acute myeloid leukemia and expresses CD123 not CD19 antigen. Three days following MOLM13 cell injection, mice were intravenously injected with a course of $10 \times 10^6$ CD19bCD123-2G CAR T cells or vector control T control cells. On Days 3 (the day before treatment), 6, 8, and 11, mice were subjected to IVIS imaging to measure tumor burden (FIG. 84A). Average light intensity measured for the CD19b-CD123-2G CAR T cell injected mice was compared to that of vector control T cell injected mice to determine percent lysis of MOLM13 cells. Mice injected with CD19b-CD123 CAR T cells had 99% less tumor burden than control mice on day 11 (FIG. 84A).

FIG. 84B showed that NSG mice injected with MOLM13 tumor cells survived significantly longer when treated with CD19b-CD123 CAR T cells. Ten sublethally irradiated NSG mice intravenously injected with MOLM13 cells ($1\times10^6$) to induce measurable tumor formation, were intravenously injected three days later with CD19b-CD123 CAR T cells or vector control T control cells ($10\times10^6$). Following the IVIS imaging experiments previously described, mice were observed every day for symptoms of severe illness, and were sacrificed once movement was greatly impaired. All control mice died by Day 18, while the CD19b-CD123 CAR T treated mice survived longer than control mice by up to 15 days (FIG. 84B). This difference between the groups was shown to be significant by the Mantel-Cox test (0.0031) and the Gehan-Breslow-Wilcoxon test (P=0.0043).

A similar result was seen in REH leukemic mice injected CD19b-CD123-2G CAR T cells. REH is an acute lymphoblastic leukemic cell line expressing CD19. REH leukemic mice injected with CD19b-CD123 CAR T cells had 99% less tumor burden than control mice on day 16 (FIG. 84C). CD19b-CD123 CAR T injected mice survive much longer than control mice.

While initial remission rates of approximately 90% are commonly seen in patients with B-ALL using CD19CAR, most patients relapse within a year. The relapse is at least in part due to antigen escape. Thus, more effective CAR T cell treatments to prevent relapse are urgently needed.

It is believed that a single antigen-directed CAR immunotherapy, such as CD19 CAR alone probably will not be sufficient for long-term durable remissions in many patients with B cell lymphoblastic leukemia or B-cell lymphoma, and points to the potential for targeting multiple cancer-related antigens. CD123 antigen is highly expressed in most B-ALL cells and its expression is also present in leukemic stem cells.

In the present disclosure, CD19 or CD123 or both are the targets for CD19-CD123 cCAR or CD19-CD123 cCAR therapy.

In one embodiment, the engineered cell includes CD19-CD123 cCAR composing of a first chimeric antigen receptor polypeptide having a CD19 antigen recognition domain and second chimeric antigen receptor polypeptide having a CD123 recognition domain. In one embodiment, this engineered cell includes a polypeptide of SEQ ID NO. 67, 128, and corresponding polynucleotide of SEQ ID NO. 68 and 129.

In one embodiment, each CAR unit includes the same or different hinge region. In another embodiment, each CAR unit includes the same or different transmembrane region. In another embodiment, each CAR unit includes the same or different intracellular domain.

In one embodiment, each CAR unit includes the CD3 zeta chain signaling domain.

In one embodiment, each distinct CAR unit includes different co-stimulatory domains. For example, the first chimeric antigen receptor polypeptide includes a 4-1BB co-stimulatory domain; and the second chimeric antigen receptor polypeptide includes a CD28 co-stimulatory domain.

In one embodiment, each distinct CAR unit includes the same co-stimulatory domains. For example, the first chimeric antigen receptor polypeptide includes a 4-1BB co-stimulatory domain; and the second chimeric antigen receptor polypeptide includes a 4-1BB co-stimulatory domain.

In one embodiment, each distinct CAR unit includes the same co-stimulatory domains. For example, the first chimeric antigen receptor polypeptide includes a CD28 co-stimulatory domain; and the second chimeric antigen receptor polypeptide includes a CD28 co-stimulatory domain.

In present disclosures, CD19 or CD123 or both are the targets for CD19-CD123 CAR or CD123-CD19 CAR therapy.

In some embodiments, a compound CAR targets a cell expressing CD19 or CD123 antigens or both. The targeted cells may be cancer cells or proliferation diseases, such as, without limiting, lymphomas, or leukemia, acute myeloid leukemias, chronic myeloproliferative neoplasms, chronic myeloid leukemia, chronic myelomonocytic leukemia, acute neutrophilic leukemia and myelodysplastic syndromes, transient myeloproliferative disorders, granulocytic sarcomas, Hodgkin lymphoma and blastic plasmacytoid dendritic cell neoplasm.

The present disclosure further discloses a compound CD19b-CD123 cCAR construct with enhanced potency of anti-tumor activity against cells co-expressing target antigens, CD19 and CD123 and yet retains sensitivity to tumor cells only expressing one antigen. In addition, each unit of CAR of the compound CAR includes one or two co-stimulatory domains and exhibits potent killing capability in the presence of the specific target.

CD123 is expressed on a subset of leukemic cells related to leukemic stem cells (LSCs), the ablation of which is essential in preventing disease refractoriness and relapse.

In accordance with the present disclosure, the compound CD19b-CD123 cCARs is highly effective for therapeutic treatment of the LSC population.

In some embodiments, the invention disclosure comprises methods and compositions of deleting both bulky leukemic blasts and rare leukemic stem cell population by CD19b-CD123-2G cCAR or CD19b-CD123-2G cCAR T or NK cells to prevent disease relapses and provide better therapeutic outcomes While not wishing to be limited by any one theory, it is believed that CD19-CD123 cCAR or CD123-CD19 cCAR can overcome conventional therapeutic failures due to antigen loss or escape.

In some embodiments, a cCAR has multiple units of CARs in a vector. In other embodiments, a cCARs targets and binds two or more different antigens.

It is believed that a single antigen-directed CAR immunotherapy, such as CD19 CAR alone probably will not be sufficient for long-term durable remissions in many patients with B cell lymphoblastic leukemia or B-cell lymphoma, and points to the potential for targeting multiple cancer-related antigens. CD123 antigen is highly expressed in most B-ALL cells and its expression is also present in leukemic stem cells.

CD19-BAFFR or BAFFR-CD19 cCAR Targeting B Cell Lymphoma

While initial remission rates of approximately 90% are commonly seen in patients with B-ALL using CD19CAR, most patients relapse within a year. The relapse is at least in part due to antigen escape. Thus, more effective CAR T cell treatments to prevent relapse are urgently needed.

B cell activating factor (BAFF) and its receptor BAFFR are key for survival and growth of mature normal and malignant B-cells.

It is believed that a single antigen-directed CAR immunotherapy, such as CD19 CAR alone probably will not be sufficient for long-term durable remissions in many patients with B cell lymphoblastic leukemia or B-cell lymphoma, and points to the potential for targeting multiple cancer-related antigens. BFFR antigen is highly expressed in most B-ALL cells.

In one embodiment, the engineered cell includes CD19-BAFFR cCAR composing of a first chimeric antigen receptor polypeptide having a CD19 antigen recognition domain and second chimeric antigen receptor polypeptide having a BAFFR recognition domain. In one embodiment, this engineered cell includes a polypeptide of SEQ ID NO. 172 and corresponding polynucleotide of SEQ ID NO. 173.

In one embodiment, an engineered cell includes a BAFFR CAR composing of a chimeric antigen receptor polypeptide having a BAFFR antigen recognition domain. In one embodiment, this engineered cell includes a polypeptide of SEQ ID NO. 144 and corresponding polynucleotide of SEQ ID NO. 145. BAFFR CAR can efficiently eliminate lymphomas or leukemias expressing BAFFR antigen.

BAFFR CAR Target an Antigen Polypeptide Including SEQ ID NO. 141

In one embodiment, each distinct CAR unit includes different co-stimulatory domains. For example, the first chimeric antigen receptor polypeptide includes a 4-1BB co-stimulatory domain; and the second chimeric antigen receptor polypeptide includes a CD28 co-stimulatory domain.

In present disclosures, CD19 or BAFFr (BAFF-R or BAFF receptor) or both are the targets for CD19-BAFFR cCAR or BAFFR-CD19 cCAR therapy.

The present disclosure further discloses a compound CD19-BAFFR CAR construct with enhanced potency of anti-tumor activity against cells co-expressing target antigens, CD19 and BAFFR and yet retains sensitivity to tumor cells only expressing one antigen. In addition, each unit of CAR of the compound CAR includes one or two co-stimulatory domains and exhibits potent killing capability in the presence of the specific target.

In accordance with the present disclosure, the compound CD19-BAFFR CARs is highly effective for therapeutic treatment of the B-cell lymphoma or leukemia or prevention of disease relapses.

In accordance with the present disclosure, the compound CD19-BAFFR CARs is highly effective for therapeutic treatment of autoimmune disorders associated with autoimmune B cells or plasma cells described in this invention CD19-CD22 cCAR can also provide effective therapeutic treatment for the B-cell lymphoma or leukemia or prevent disease relapses.

In one embodiment, the engineered cell includes CD19-CD22 cCAR composing of a first chimeric antigen receptor polypeptide having a CD19 antigen recognition domain and second chimeric antigen receptor polypeptide having a CD22 recognition domain. In one embodiment, this engineered cell includes a polypeptide of SEQ ID NO. 166 and corresponding polynucleotide of SEQ ID NO. 167.

BCMA-CD19b cCAR Autoimmune Disorders, GVHD and Multiple Myeloma.

Generation and Characterization of BCMA-CD19b cCAR T Cells.

As disclosed above, each unit of CARs, BCMA CAR and CD19b CAR has shown a high level of CAR surface expression and potent anti-tumor activity. Therefore, these two units of CARs were chosen to construct a compound CAR, called BCMA-CD19b (FIG. 85A). The construct comprises a SFFV promoter driving the expression of multiple modular units of CARs linked by a P2A peptide. Upon cleavage of the linker, the cCARs split and engage upon targets expressing BCMA (CD269) and CD19b. The activation domains of the construct included 4-1BB on the BCMA CAR unit and a CD28 on the CD19b CAR unit. This BCMA-CD19b cCAR was designed to delete B cells and plasma cells associated with autoimmune disorders or organ rejections. In addition, the BMCA-CD19b cCAR can be used for targeting B cell lymphoma or multiple myeloma, and offset the tumor antigen escape.

T-cells isolated from peripheral blood (PB) buffy coats were transduced with BCMA-CD19b cCAR lentivirus after 2 days of activation. BCMA-CD19b cCAR transduction efficiency was determined to be 20.6% as determined by flow cytometry (FIG. 85B). Single CARs consisting of BCMA (anti-BCMA) and CD19b (anti-CD19) were also generated and transduced with lentivirus to produce comparable CARs for analysis. Efficiency was determined by flow cytometry (FIG. 85B).

BCMA-CD19b cCAR T-Cells Exhibit Independent Dual scFv Functionality in Assays Against Artificial Antigen Presenting Cells.

A chronic myelogenous leukemia cell line, K562, was used to create artificial CD19 and BCMA expressing cells to assay for scFv functionality in the BCMA-CD19b cCAR. K562 cells were transduced with CD19 and BCMA expressing lentiviruses and sorted for expansion into stable artificial antigen expressing cell lines. After sustained culture, both K562 cell lines expressing CD19 (K-19) and K562 cells expressing BCMA (K-BCMA) were >90% positive for their respective antigens. BCMA-CD19b cCAR (also called cCAR) T-cells significantly eliminated both K-19 and K-BCMA populations in separate co-cultures after 16 hours (FIG. 85C, 85D) while cCAR did not affect the non-antigen expressing tumor cells such as wild-type K562 (FIG. 85E). In contrast, BCMA 2G CAR T-cells did not lyse BCMA negative K-19 cells while CD19b-BB-2G CAR T-cells were unable to lyse CD19 negative K-BCMA cells (FIGS. 85C and 85D). All CAR T-cells could not lyse non-antigen presenting wild type K562 cells (FIG. 85E).

To test for function of the BCMA-CD19b cCAR in an environment where multiple target antigens are present, we conducted co-culture assays where K-BCMA and K-19 cells were mixed in 1:1 ratio. BCMA-CD19b CAR T-cells were then added at an E:T ratio of 5:2 and analyzed for target depletion via flow cytometry. After 24 and 48 hours, BCMA-CD19b cCAR T-cells showed robust activity against both distinct populations of K-BCMA and K-19 cells (FIG. 86A)

BCMA-CD19b cCAR T-Cells Show Potent Anti-Tumor Effect Against Multiple Myeloma Cell Lines when Compared to Single CD19b CAR.

Further characterization of the BCMA-CD19b cCAR anti-tumor activity was done at E:T ratios of 2:1 and 5:1 against MM1S, RPMI-8226, and U266 myeloma cells lines prelabeled with Celltracker (CMTMR). CD19b CAR T-cells were used as a comparison for anti-tumor activity due to recent reports of CD19 CAR in multiple myeloma clinical trials. BCMA-CD19b cCAR T-cells were able to lyse all 3 myeloma cell lines at increasing potency correlated with E:T ratio ranging from 50-95%+ depletion (FIG. 86). CD19b CAR T-cells could exhibit some anti-tumor activity in the MM1S cell line, however, it only had minor anti-myeloma effect in the RPMI-8226 cells and no effect in the U266 cell line. The results further characterize the potency of BCMA-CD19b cCAR T-cells in vitro.

Evaluation of cCAR Activity Against Mixed Cell Lines Expressing Separate Antigens in a Dose-Escalation Model.

To supplement the mixed antigen experiment conducted with artificial K562 cells, cCAR T-cells were also used in a co-culture against tumor cell lines expressing each target epitope. An B-cell acute lymphoblastic leukemia cell line, REH expressing CD19, (K-19) was mixed at 1:1 ratio with the myeloma cell line RPMI-8226 and cultured with BCMA-CD19b cCAR T-cells at increasing E:T ratios for 24 hours and 48 hours. Compared to control, BCMA-CD19 cCAR T-cells were able ablate both populations of tumor cells at increasing potency ranging from 20-95%+ as E:T ratios increased (FIG. 87). More target cell depletion was observed after 48 hours when compared to 24 hours (FIG. 87A, Figure. 87B). The anti-tumor activity exhibited in this assay revealed a dose-response tumor-lysis dependent on E:T ratio, with relatively rapid increases in efficacy as ratios are increased to a standard 5:1 (FIG. 87).

cCAR T-Cells Exhibit Anti-Tumor Activity Against Primary Myeloma Samples.

In vitro characterization of CAR activity against primary myeloma samples was also performed, using a majority BCMA positive MM7-G patient sample. MM7-G primary cells were pre-labeled with Celltracker (CMTMR) and cultured for 24 hours with CD19b, BCMA, or BCMA-CD19b cCAR T-cells (FIG. 88A). While all CAR cells exhibited anti-tumor activity >40% especially at higher E:T ratios, the BCMA-CD19b cCAR was more comparable to BCMA CAR in that it lysed more effectively than CD19b CAR after 24 hours.

BCMA-CD19b cCAR T-Cells Exhibit Potent Anti-Tumor Effect in a Mixed Antigen Xenogeneic Mouse Model.

To construct a model for testing the efficacy of a compound CAR using two distinct scFvs, we designed a xenogeneic mouse model using NSG mice sublethally irradiated and intravenously injected with luciferase-expressing MM1S cells expressing BCMA and REH cells expressing CD19. BCMA and CD19 expressing MM1S and REH cells, respectively, were then mixed at a 1:1 ratio respectively before injection to model differential tumor environments. Three days following tumor cell injection, mice were intravenously injected with 10×10⁶ control T-cells, and BCMA-CD19b cCAR. On days 6, 8, and 11, mice were injected subcutaneously with RediJect D-Luciferin (Perkin Elmer) and subjected to IVIS imaging to visualize tumor burden on both ventral and dorsal sides (FIGS. 88B and 88C). Average light intensity (signifying tumor burden measured in photons/sec) measured for the BCMA-CD19b cCAR T-cell injected mice was compared to that of control injected mice in order to determine the control of tumor growth by treatment. In summary, these in vivo data, specifically in terms of tumor intensity indicated by IVIS, show that BCMA-CD19b cCAR T-cells result in improved tumor burden control for multiple antigen populations.

In one embodiment, the engineered cell includes a BCMA-CD19 cCAR composing of a first chimeric antigen receptor polypeptide having a BCMA antigen recognition domain and second chimeric antigen receptor polypeptide having a CD19 recognition domain. In one embodiment, this engineered cell includes a polypeptide of SEQ ID NO. 49, 51, 251 and corresponding polynucleotide of SEQ ID NO. 50, 52, 252.

BCMA-CS1 cCARs

BCMA-CS1 cCARs for Treatment of Multiple Myeloma

While initial remission rates of approximately 90% are commonly seen in patients with B-ALL using CD19CAR, most patients relapse within a year. The relapse is at least in part due to antigen escape. Thus, more effective CAR T cell treatments to prevent relapse are urgently needed.

Current CAR technology efforts in multiple myeloma involve the use of a BCMA (CD269) targeted CAR T-cell against bulk disease, as spearheaded by James Kochenderfer (NIH). Those patients in remission after BCMA CAR treatment eventually relapse and this may due to the fact that some myeloma cells are dim (weak) or negative expression for BCMA. Therefore, a single target for CAR based treatment may not be sufficient to prevent myeloma relapse. CS1 (SLAMF7) is another good target for myeloma as its expression is typically high and uniform in myeloma cells as well as being implicated in myeloma cell adhesion and tumorigenicity. The CS1 monoclonal antibody (elotuzumab) has been currently used for treating myeloma in clinic.

Concurrent with the trend for relapse, a novel approach to the treatment of multiple myeloma CAR therapy is necessary to augment the response currently seen in BCMA single CAR trials. Tumor relapse can be initiated from several factors, one of which includes the survival of residual myeloma cells expressing a different antigen, or dim expression of a main target antigen (mentioned above). Furthermore, refractory disease can arise from incomplete coverage of CAR targeted destruction and lack of CAR persistency. We believe that targeting multiple myeloma with a compound CAR targeting both BCMA and CS1 in combination could be a very strong strategy. Potentially, this novel approach circumvents the antigen escape (loss of a single antigen) from selection pressure of single CAR treatment due to combinatorial pressure from a compound design. Similar to the reasoning behind combination chemotherapy regimens, agents working in concert are more likely to lead to the eradication of disease with decreased risk of refractory outcomes.

As shown in FIG. 24 to 29 above, we generated a compound CAR (BCMA-CS1 cCAR) whereby a lentiviral vector encoding 2 discrete CAR units (FIG. 89A) can more broadly target and eradicate cell types of multiple myeloma that were advantaged by BCMA CAR selection pressure in vitro and in vivo.

BCMA-CS1 cCAR Shows Depleted Tumors and Enhance CAR T Cell Persistency.

To construct a model for potential antigen escape or multiple antigen tumor populations, we designed a xenogeneic mouse model using NSG mice sublethally irradiated and intravenously injected with luciferase-expressing K562 cells expressing either stably transduced BCMA or CS1. BCMA and CS1 expressing K562 cells were further sorted for expression following puromycin selection and established as stable homogenous single antigen populations. BCMA and CS1 expressing K562 cells were then mixed at a 4:1 ratio respectively before injection to model potential antigen escape. Leukemic mice were then administrated with BCMA-CS1 cCAR T cells. Whole blood and liver tissue samples were taken from representative mice in the CS1-K562 experimental group at time of sacrifice and were labeled with CD3, CD45, and CS1 antibodies to screen for tumor and T-cell persistency. Two such representative flow diagrams were shown. All control and cCAR mice showed the same trends across each mouse for their respective treatment groups (n=19). Control mice showed low T-cell persistency (blue) with a very small or no T cell population, and apparent CS1-K562 tumor populations (purple) when compared to cCAR treated (FIG. 89B) with a large population of T cells, and no tumor population detected. Similar experimental setup and collection were conducted for the BCMA-K562 experimental group and similar trends in tumor ablation and T-cell persistency in the cCAR treated mice are observed (FIG. 89C).

Generation and Characterization of Additional Versions of BCMA-CS1 cCARs for Treatment of Multiple Myeloma.

Additional BCMA-CS1 cCAR were generated (FIGS. 89A and 90). When designing a longer gene construct using a lentiviral vector, the level of protein expression drops significantly with each 1 kb of additional length. In general, we obtain lower transduction efficiencies with our compound CARs, than with the single CARs that would constitute the cCAR. Transduction efficiencies below 15% can also result in decreased killing efficiency of CAR T cells against target cells in co-culture. Therefore, in order to have a higher expression level for a cCAR, we performed a screen of various scFv antibody sequences for our single CS1 (Slamf7 or CD319) and BCMA(CD269) CAR constructs to determine the highest transduction efficiency for each, before incorporating them into a longer BCMA-CS1 cCAR. FIGS. 89A and 90 showed the transduction efficiency between activated T cells transduced with CS1-mu34-28-2G, CS1-mu90-28-2G, CS1-hu63-28-2G, BCMA-A7D-28-2G, and BCMA-C11D-28-2G CAR lentiviral vector.

FIG. 90 showed the transduction efficiency between activated T cells transduced with CAR lentiviruses. CARs with a relatively high level of CAR expression, were selected for further analysis. These CARs are CS1-mu34-28-2G, CS1-mu90-28-2G, CS1-hu63-28-2G, CD269-A7D-28-2G, and CD269-C11D-28-2G CAR. CAR expression was determined by labeling with goat anti-mouse F(Ab')2 antibody. The two BCMA CARs, CD269-A7D-28-2G, and CD269-C11D-28-2G, resulted in similar efficiencies of 33.3% and 31%, respectively. The two murine-based CS1 antibody sequences, CS1-mu34-28-2G, CS1-mu90-28-2G, 90.6% and 75.4%, respectively, with a large distinct population of very highly stained cells. However, the humanized sequence, CS1-hu63-28-2G, had a much lower transduction efficiency of 21.1% and no population of highly stained cells.

We screened various new BCMA and CS1 CAR constructs against the BCMA$^+$ CS1+MM1S cell line in comparison with our currently used BCMA and CS1 constructs described herein and above. While all BCMA CAR constructs show potent lysis of MM1S overnight at an E:T of 5:1, all new CS1 CAR constructs show increased cytotoxicity compared to our currently used CS1 CAR T-cell.

In one embodiment, an engineered cell includes a BCMA CAR composing of a chimeric antigen receptor polypeptide having a BMCA antigen recognition domain. In one embodiment, this engineered cell includes a polypeptide of SEQ ID NO. 176 and 178, and corresponding polynucleotide of SEQ ID NO. 177 and 179, respectively.

In one embodiment, an engineered cell includes a CS1 CAR composing of a chimeric antigen receptor polypeptide having a CS1 antigen recognition domain. In one embodiment, this engineered cell includes a polypeptide of SEQ ID NO. 180, 182, 184, and corresponding polynucleotide of SEQ ID NO. 181, 183, 185, respectively.

The same strategy described herein and above was also used to generate multiple different versions of cCAR, BCMA-A7D-CS1-mu34-2G, BCMA-A7D-CS1-hu63-2G, BCMA-C11D-CS1-mu90-2G, BCMA-C1 D-CS1-hu63-2G, and BCMA-A7D-CS1-mu90-2G. These cCARs target cells expressing BCMA or CS1 or both.

In one embodiment, an engineered cell includes BCMA-A7D-CS1-mu90-2G cCAR composing of a first chimeric antigen receptor polypeptide having a BCMA antigen recognition domain and second chimeric antigen receptor polypeptide having a CS1 recognition domain. In one embodiment, this engineered cell includes a polypeptide of SEQ ID NO. 197 and corresponding polynucleotide of SEQ ID NO. 198.

In one embodiment, an engineered cell includes BCMA-C11D-CS1-hu63-2G cCAR composing of a first chimeric antigen receptor polypeptide having a BCMA antigen recognition domain and second chimeric antigen receptor polypeptide having a CS1 recognition domain. In one embodiment, this engineered cell includes a polypeptide of SEQ ID NO. 199 and corresponding polynucleotide of SEQ ID NO. 200

In one embodiment, an engineered cell includes BCMA-C11D-CS1-mu34-2G cCAR composing of a first chimeric antigen receptor polypeptide having a BCMA antigen recognition domain and second chimeric antigen receptor polypeptide having a CS1 recognition domain. In one embodiment, this engineered cell includes a polypeptide of SEQ ID NO. 201 and corresponding polynucleotide of SEQ ID NO. 202.

In one embodiment, an engineered cell includes BCMA-C11D-CS1-mu90-2G cCAR composing of a first chimeric antigen receptor polypeptide having a BCMA antigen recognition domain and second chimeric antigen receptor polypeptide having a CS1 recognition domain. In one embodiment, this engineered cell includes a polypeptide of SEQ ID NO. 203 and corresponding polynucleotide of SEQ ID NO. 204.

In particular embodiments, the engineered cell includes BCMA-A7D CAR linked to IL15/IL-15sushi via the P2A cleavage sequence. A polypeptide providing this embodiment includes SEQ ID No. 148 and corresponding polynucleotide sequence SEQ ID No. 149.

In particular embodiments, the engineered cell includes BCMA-A7D CAR linked to 4-1BBL via the P2A cleavage sequence. A polypeptide providing this embodiment includes SEQ ID No. 140 and corresponding polynucleotide sequence SEQ ID No. 141.

In particular embodiments, the engineered cell includes BCMA-A7D CAR linked to IL-15/IL-15sushi anchor via the P2A cleavage sequence. A polypeptide providing this embodiment includes SEQ ID No. 142 and corresponding polynucleotide sequence SEQ ID No. 143.

In particular embodiments, the engineered cell includes BCMA-CS1 cCAR linked to IL-15/IL-15sushi via the T2A or P2A cleavage sequence. A polypeptide providing this embodiment includes SEQ ID No. 205 and corresponding polynucleotide sequence SEQ ID No. 206.

CD123b-CD33b-2G cCAR (CD123b-CD33b-2G CAR) T Generation of cCAR (CD123b-CD33b-2G CAR) Targeting CD123 and CD33 Antigens.

A cCAR contains two units of CARs, CD123 CAR and CD33 CAR, targeting tumor cells expressing either CD123 or CD33 or both antigens. CD123 CAR and CD33 CAR were used to construct a cCAR shown in FIG. 91A.

The construct comprises a SFFV promoter driving the expression of multiple modular units of CARs linked by a P2A peptide. Upon cleavage of the linker, the cCARs split and engage upon targets expressing CD123 and CD33. The activation domains of the construct included 4-1BB on the CD123 CAR unit and a CD28 on the CD33 CAR unit. This CD123-CD33b cCAR was designed to delete AML cells including leukemic stem cells and prevent leukemia relapses. The surface expression of CD123b-CD33b-2G CAR on the isolated human T cells was approximately 25% shown in FIG. 91B.

CD123bCD33b-2G CAR T Cells Efficiently Lyse AML Tumor Cell Lines in an In Vitro Assay The CD123bCD33b-2G CAR T cells were assayed for their ability to lyse AML tumor cell lines, MOLM13 and U937. The results are summarized in FIGS. 91C and 91D. CD123bCD33b-2G cCAR T cells or control T cells were co-cultured with either MOLM13 or U937 cells 16 hours at E:T ratios of 2:1 and 5:1. After 16 hours, cells were stained with mouse anti-human CD3, CD33, and CD123 and analyzed by flow cytometry. CD123bCD33b-2G CAR T cells showed near complete depletion of both cell lines at even the lower 2:1 E:T ratio. (FIGS. 91C and 91D). Since the U937 cell line is CD33+/CD123− (as shown on the lower right of FIG. 91D), all killing by the CAR T cells can be attributed to the CD33b antibody on the CAR. MOLM13 is a AML cell line expressing both CD123 and CD33.

CD123b-CD33b-2G CAR T Cells Efficiently Lyse Patient Leukemic Cells in In Vitro Assays CD123b-CD33b-2G CAR T cells were then assayed for their ability to lyse tumor cells in both AML and B-ALL patients. The results are shown in FIGS. 91E and 91F.

CD123b-CD33b-2G CAR T cells or control T cells were co-cultured with cells from a patient diagnosed with AML (PT1) and another patient with B-ALL (PT2) partially expressing CD123 at E:T ratios of 2:1 and/or 5:1. Over 80% of the cells in the sample from the patient with AML were leukemic cells and they were positive for CD33, and 25% of the leukemic cells in the sample from the patient with B-ALL were positive for CD123 expression. After 24 hours, co-cultured cells were stained with mouse anti-human CD3, and either CD33, or CD123 and analyzed by flow cytometry. CD123bCD33b-2G CAR T cells were able to eliminate 95% and ~100%% of PT1 CD33+ cells at 2:1 and 5:1 ratios, respectively (FIG. 91E). The CD123bCD33b-2G CAR T cells lysed ~100% of the CD123-expressing PT2 cells at 24 hours (FIG. 91F). These results show that both the CD33b and CD123b units of the cCAR are able to specifically lyse target cells with equal or similar high efficiency for CD33- and CD123-positive cells in patients with either AML or B-ALL.

CD33-CD123-28-2G cCAR T-Cells are Able to Selectively and Potently Lyse CD33 Expressing Target Cells To further investigate the specific function of the CD33b-CD123b-28-2g cCAR T cell, we generated a partial CD33 expressing cell line by transducing a T-ALL cell line Jurkat with the full length of CD33 cDNA to express CD33 (FIG. 91G). Jurkat cell line does not express CD33. This partial CD33 positive population of Jurkat cells resulting from over-expression of CD33 cDNA was exhibited by less than 20% of the overall population, however, flow cytometry revealed a distinct CD33 positive population (FIG. 91G). We observed that after 24 hours of co-culture with the cCAR, this entire CD33 positive population was abated at a low E:T ratio of 2:1 (FIG. 91G). Percentages between 90-95% ablation were observed for samples at 2:1 cCAR treatment (FIG. 91G). Furthermore, the general CD33 negative Jurkat population under cCAR treatment remained largely unaffected when compared to control. This highlights the targeting specificity of the CD123-CD33-28-2G cCAR against its target antigen.

CD33-CD123-28-2G cCAR T-Cells can Selectively and Potently Lyse CD34+CD38-Leukemic Stem Cell Population.

We further tested the ability of the CD123b-CD33b-2G cCAR to ablate different populations in human primary AML and B-ALL cells in vitro. We found that CD123b-CD33b-2G cCAR T cells could eliminate the bulk CD34+ disease in primary AML cells at a very high efficacy (>99%) even at E:T ratios as low as 2:1 (FIG. 91H). Furthermore, analysis of the potential CD34+CD38− leukemic stem cell population or CD34+CD38+ progenitor leukemic stem cell population showed that CD123b-CD33b-2G cCAR T-cells were also able to virtually delete these two populations even at 2:1 E:T ratios. We also observed (FIG. 91I) that CD123b-CD33b-2G cCAR T-cells could potently ablate B-ALL target cells expressing CD123, including cells with relapse potential as currently observed in CD19CAR clinical trials. These CD19+ or CD19− (or CD19 dim positive) cells were also positive for CD34 and CD123, and this population of cells were ablated at high efficiency even at E:T ratios of 2:1 (>90%) (FIG. 91J). These results suggest that a compound CAR consisting of dual targeting of both CD33 and CD123 may be an effective means of deterring leukemic cell relapse by targeting populations of leukemic stem cells.

Remarkable Efficacy of CD123b-CD33b-2G cCAR T-Cells in Ablating Leukemic Cells.

To assay the potency of target depletion, we conducted dose-dependent experiments using two AML cell lines: HL60 and KG-1a to assay the potency of compound CAR effect. We find that even at E:T ratios as low 0.25 effector cell to 1 target cells (0.25:1 E:T), ablation reached >75% (FIG. 91K). Saturation of killing activity was accomplished at ranges of low E:T ratios such as 1:1 and 2:1 with >95% efficacy (FIG. 91K).

Figure 91:
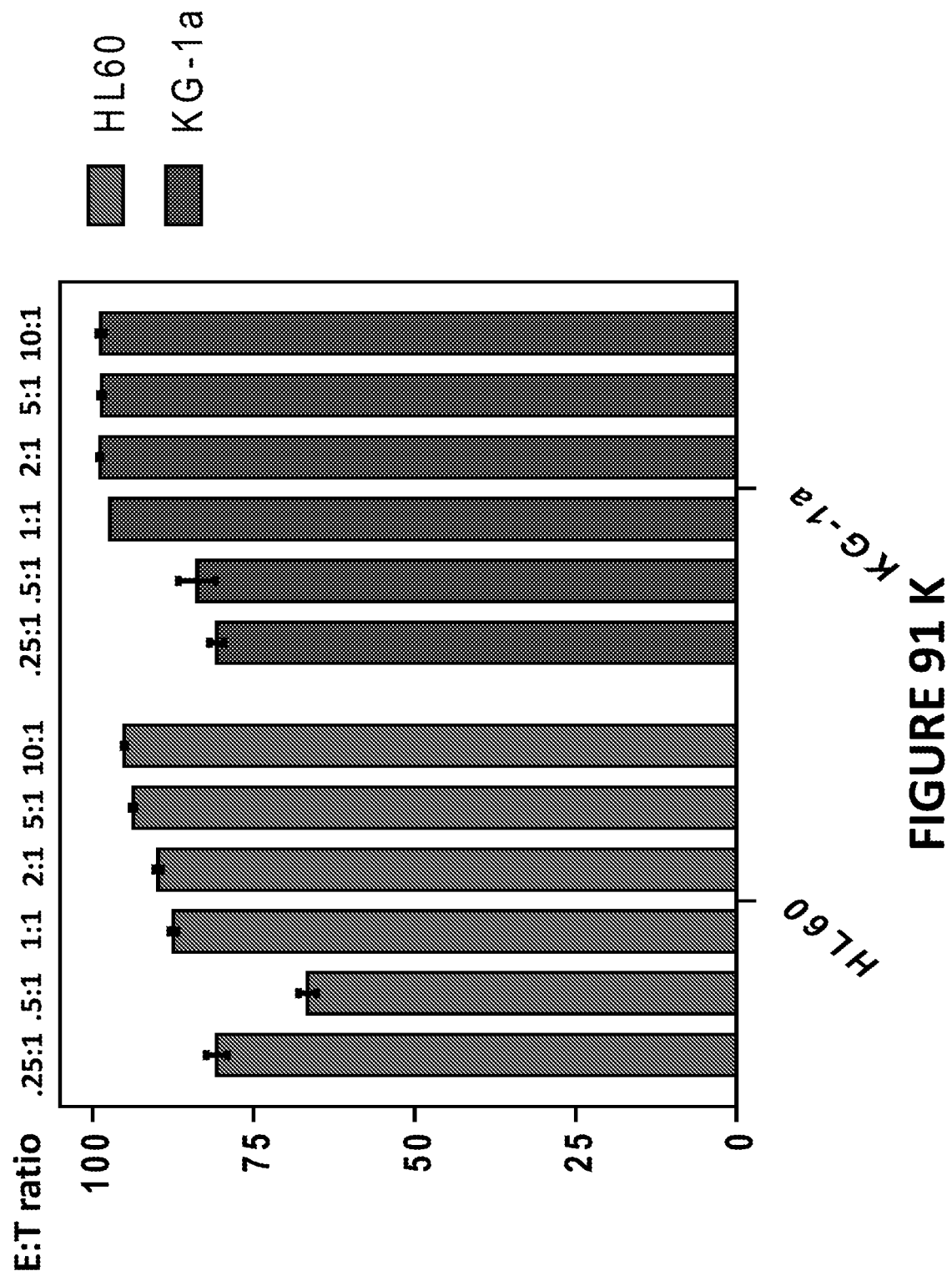
Figure 91:
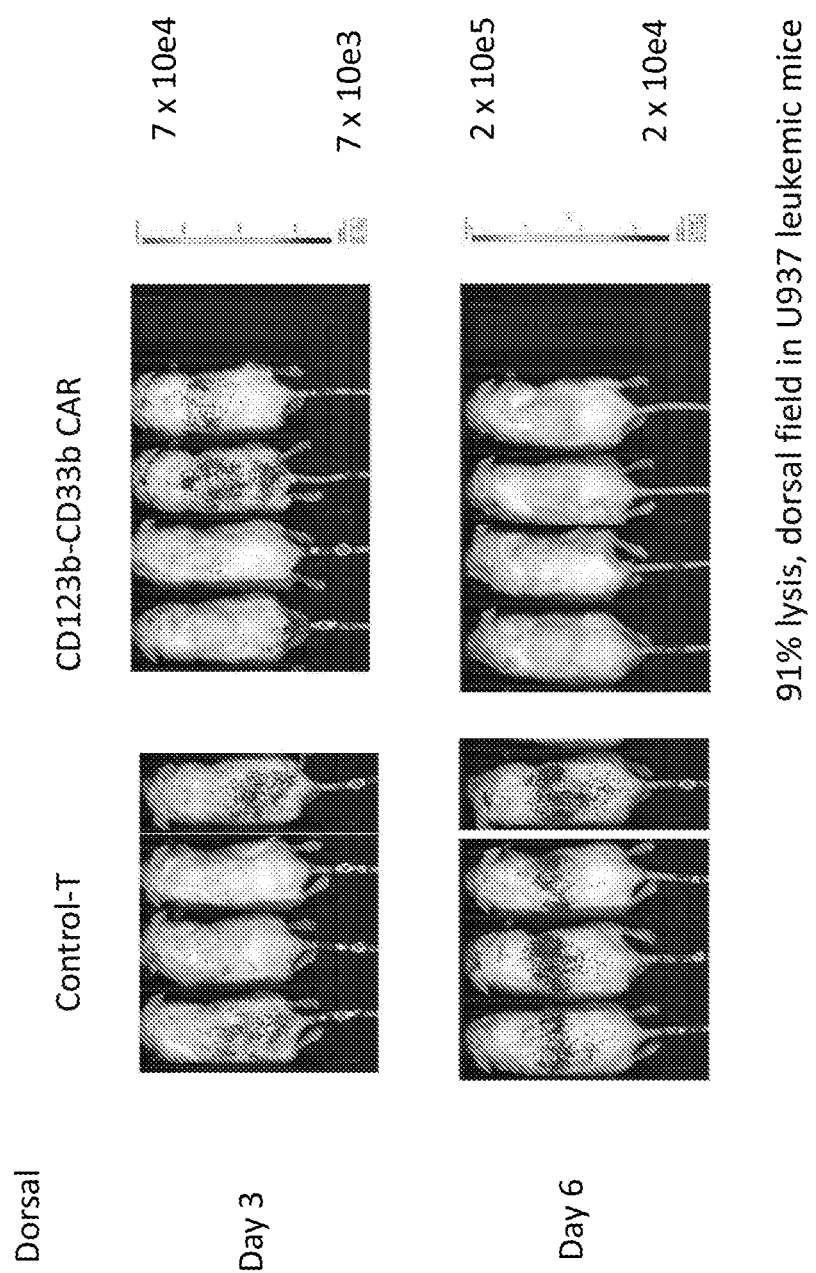
Figure 91:
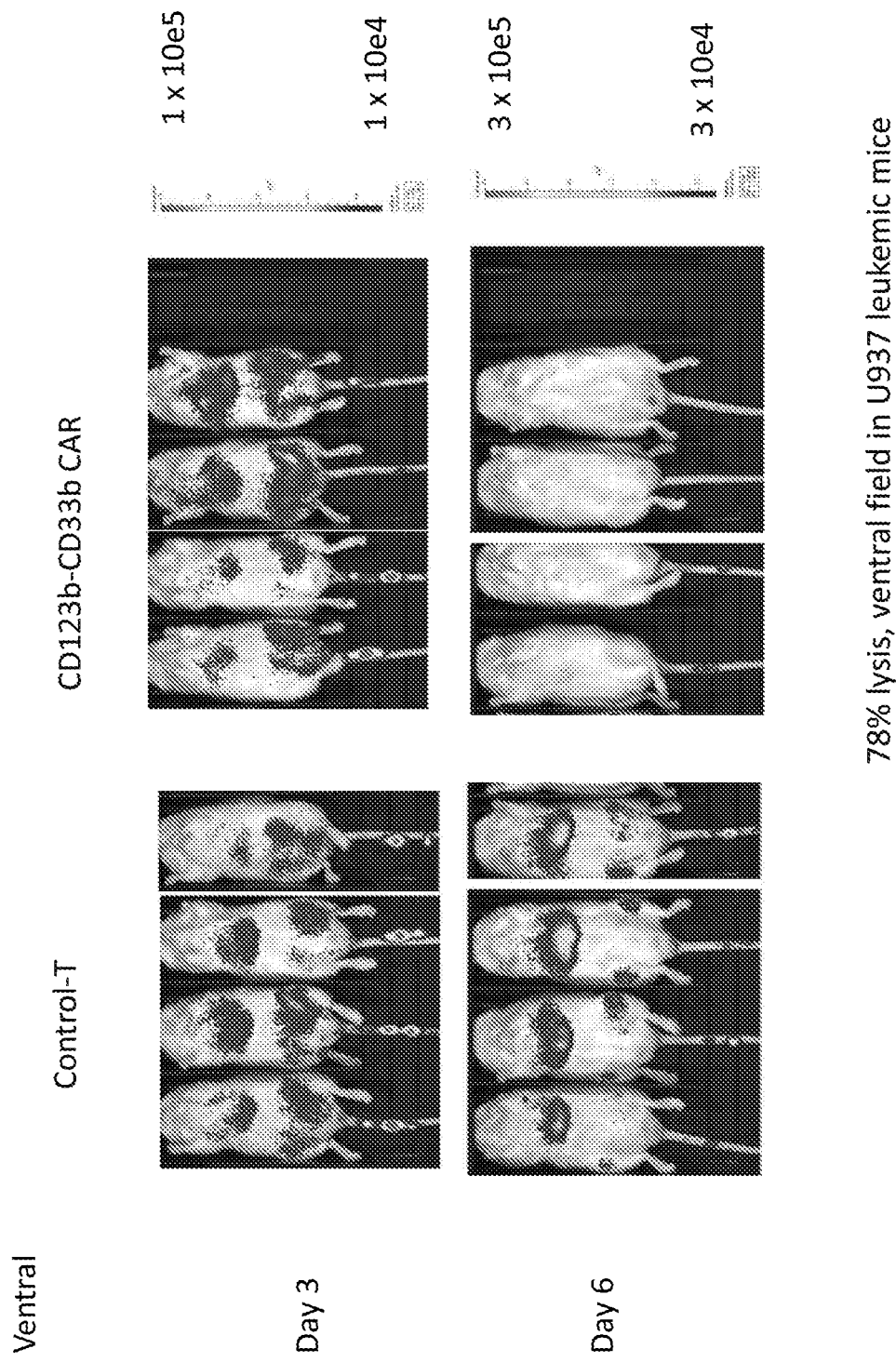
Figure 91:
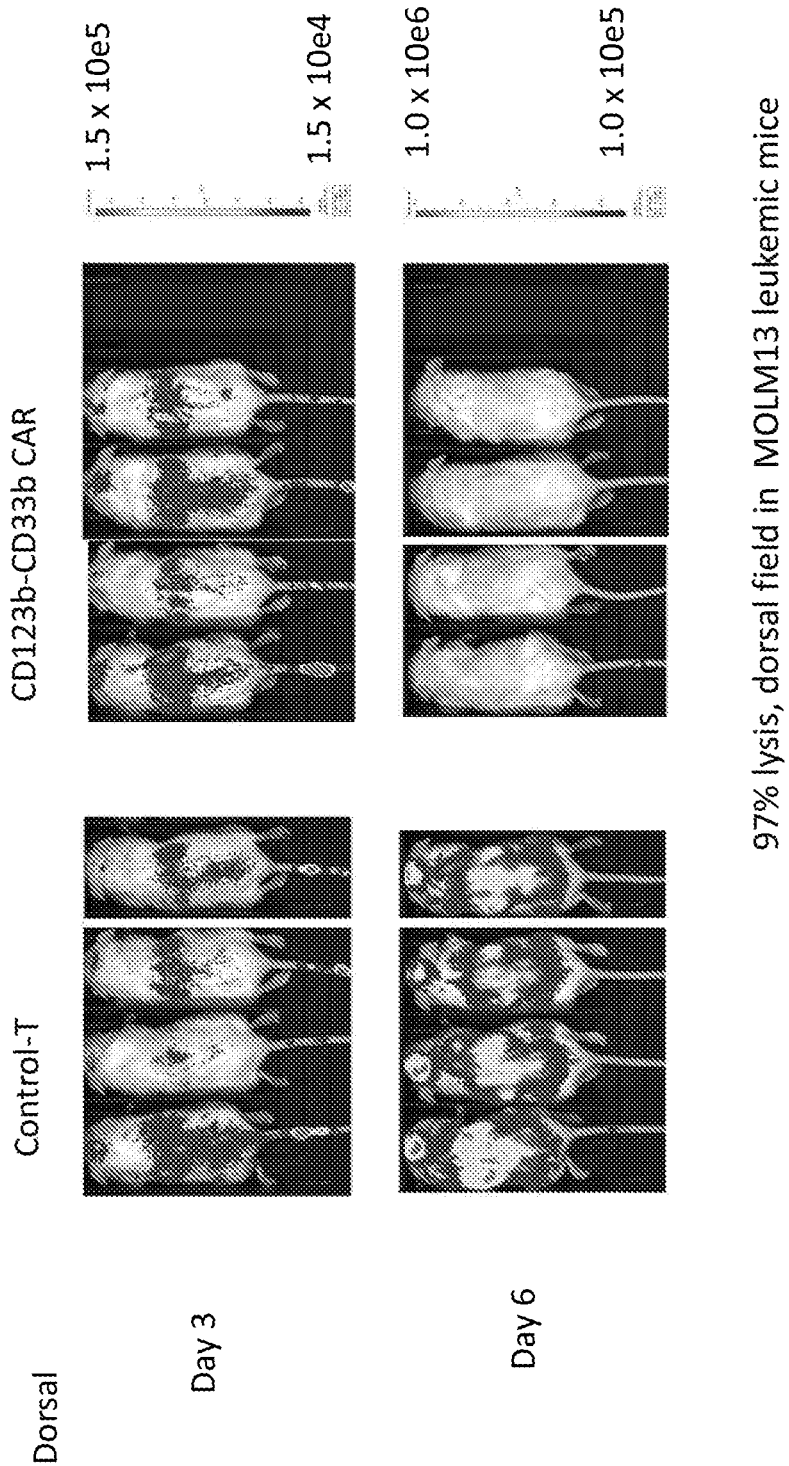
Figure 91:
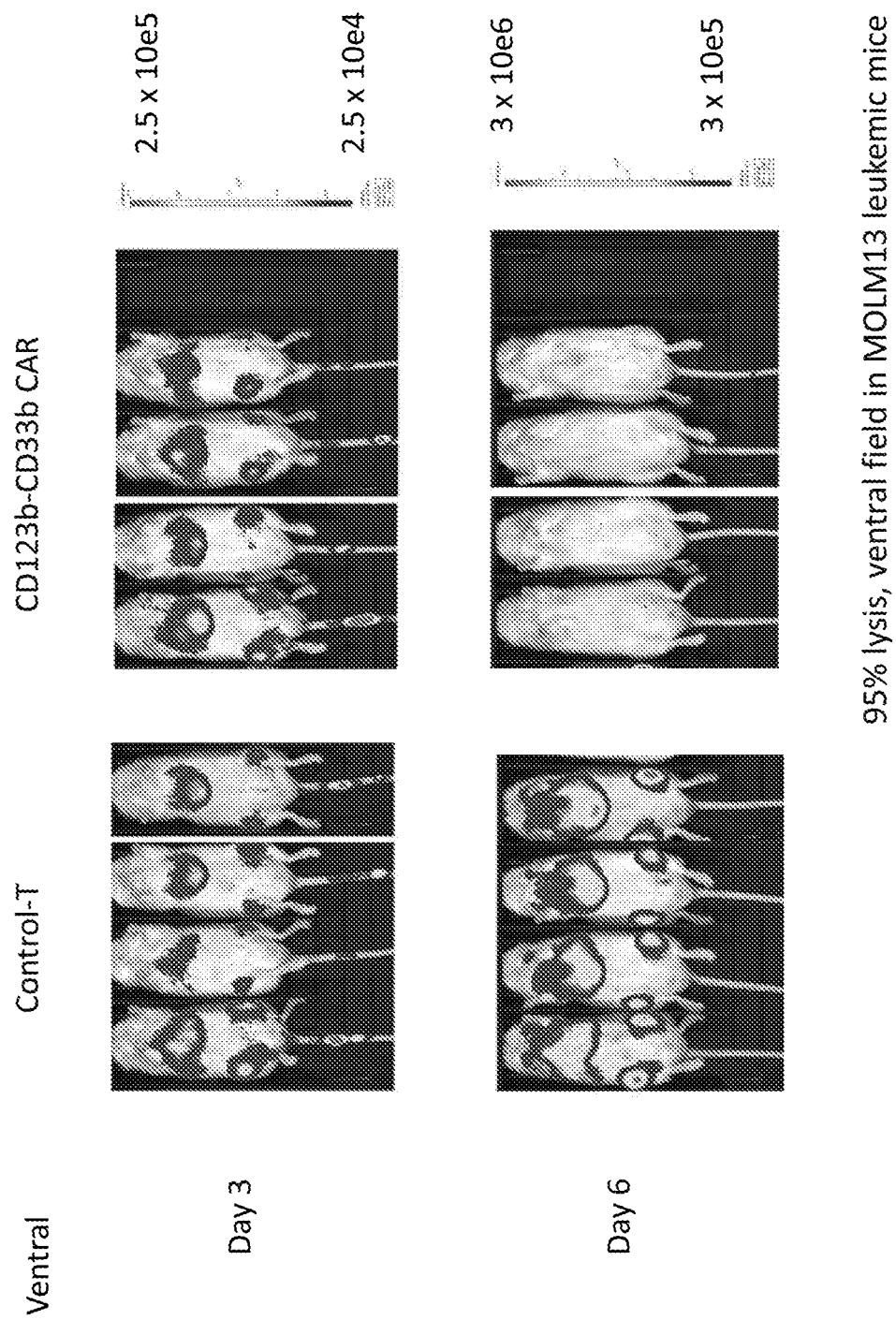

Remarkable Efficacy of CD123b-CD33b-2G cCAR T-Cells in Ablating Human Leukemic Cells in Mouse Models In order to evaluate the in vivo anti-tumor activity of CD123bCD33b-2G CAR T cells against human aggressive U937 and MOLM13 (AML) leukemic cell lines, we developed a xenogeneic mouse model using NSG mice sublethally irradiated and intravenously injected with either luciferase-expressing U937 or MOLM13 cells to induce measurable tumor formation. Three days following tumor cell injection, mice were intravenously injected with a course of $10 \times 10^6$ of CD123bCD33b-2G CAR T cells or vector control T control cells. On Day 3 (the day before treatment), and Day 6 (48 hours after treatment), mice were subjected to IVIS imaging to measure tumor burden (FIGS. 91 L and 91 M). Average light intensity measured for the of CD123b-CD33b-2G CAR T cell injected mice was compared to that of vector control T cell injected mice to determine percent lysis of targeted cells. Results showed that only 2 days following treatment with T cells (Day 6), mice injected with U937 cells and CD123bCD33b-2G CAR T cells had 91% less (dorsal view) and 78% (ventral view) lower tumor burden than control mice (FIG. 91 L). For mice with MOLM13 tumor cells, the mice treated with of CD123bCD33b-2G CAR T cells showed an even higher percentage of lysis, 97% (dorsally) and 95% (ventrally) lower tumor cell burden compared to control. This can be explained as a possible synergistic effect of the compound CAR T cells; U937 leukemic cells express CD33 antigen only, whereas MOLM13 leukemic cells express both CD33 and CD123 antigens. Thus, the compound CAR, CD123b-CD33b-2G CAR T cells, lysed the dual-target MOLM13 cells more efficiently than the single-target U937 cells. CD123b-CD33 CAR T injected mice survived much longer than control mice.

Next, we compared mouse survival across the two groups. Mice treated with CD123bCD33b-2G CAR T cells survived significantly longer than control mice (P value=0.0082 for both Mantel-Cox and Gehan-Breslow-Wilcoxon tests).

In present disclosures, CD123 or CD33 or both are the targets for CD123b-CD33b CAR or CD33-CD123 CAR therapy.

In one embodiment, the engineered cell includes CD123-CD33 cCAR composing of a first chimeric antigen receptor polypeptide having a CD123 antigen recognition domain and second chimeric antigen receptor polypeptide having a CD33 recognition domain. In one embodiment, this engineered cell includes a polypeptide of SEQ ID NO. 138 and corresponding polynucleotide of SEQ ID NO. 139.

In one embodiment, an engineered cell includes a CD123b CAR composing of a chimeric antigen receptor polypeptide having a CD123 antigen recognition domain. In one embodiment, this engineered cell includes a polypeptide of SEQ ID NO. 137, and corresponding polynucleotide of SEQ ID NO. 138

In one embodiment, an engineered cell includes a CD33b CAR composing of a chimeric antigen receptor polypeptide having a CD33 antigen recognition domain. In one embodiment, this engineered cell includes a polypeptide of SEQ ID NO. 132, and corresponding polynucleotide of SEQ ID NO. 133.

In particular embodiments, the engineered cell includes a CD33b CAR linked to IL15/IL-15sushi via the P2A cleavage sequence. A polypeptide providing this embodiment includes SEQ ID No. 188 and corresponding polynucleotide sequence SEQ ID No. 189.

In particular embodiments, the engineered cell includes a CD33b CAR linked to 4-1BBL via the P2A cleavage sequence. A polypeptide providing this embodiment includes SEQ ID No. 186 and corresponding polynucleotide sequence SEQ ID No.187.

In particular embodiments, the engineered cell includes a CD33b CAR linked to IL15/IL-15sushi anchor via the P2A cleavage sequence. A polypeptide providing this embodiment includes SEQ ID No. 190 and corresponding polynucleotide sequence SEQ ID No. 191.

In some embodiments, the disclosed disclosure comprises methods and compositions of deleting both CD123 and CD33 populations in leukemias to prevent antigen escapes associated with relapses. CAR is more powerful in eliminating leukemic cells when combination of two units of CD123 and CD33 (CD123b-CD33b) together in a vector or a cell.

In some embodiments, the disclosed disclosure comprises methods and compositions of deleting leukemic stem cells by CD123b-CD33b-2G cCAR T or NK cells to prevent disease relapses and provide better therapeutic outcomes.

In some embodiments, the invention disclosure comprises methods and compositions of deleting both bulky leukemic blasts and rare leukemic stem cell population by CD123b-CD33b-2G cCAR T or NK cells to prevent disease relapses and provide better therapeutic outcomes In a preferred embodiment, leukemias treated with CD123b-CD33b-2G cCAR (or CD123-CD33 cCAR) T or NK cells can include acute myeloid leukemia, B-ALL, myelodysplastic syndromes, chronic myeloid leukemia, chronic myeloproliferative neoplasms, granulocytic sarcoma, transient myeloproliferative disorder, chronic neutrophilic leukemia, chronic eosinophilic leukemia and chronic myelomonocytic leukemia.

A BCMA-CD19b cCAR for Treatment of Myeloma by Targeting Both BCMA and CD19 Antigens While killing multiple myeloma cells can provide short-term relief, LSCs (myeloma leukemic stem cells), if not destroyed, will always re-grow, causing the patient to relapse. It is imperative that LSCs be destroyed to achieve durable cures for multiple myeloma disease. Without wishing to be bound by theory, it is believed that a small subset of multiple myeloma cells is stem cells that are CD19 positive and associated with disease progression and relapses, and a bulky myeloma cell population is BCMA positive. Therefore, it is critical to develop new therapies that can specifically target both the myeloma stem cell population and the bulky myeloma population. A compound CAR in the present disclosure targets both BCMA and CD19 positive populations of multiple myeloma cells and is embodied herein.

In some embodiments, the present disclosure provides a method of eradicating or killing myeloma stem cells (LSCs) or bulk myeloma cells expressing CD19 or BCMA, or both. In this embodiment, a T or NK engineered cell having a BCMA unit and a CD19 unit is administered to a patient in need thereof.

In some embodiments, the disclosed disclosure comprises methods and compositions of deleting both BCMA and CD19 populations in multiple myeloma to prevent relapses. CAR is more powerful in eliminating myeloma cells when combination of two units of BCMA and CD19 (BCMA-CD19) together in a vector or a cell.

In further embodiments, a compound CAR in a T or NK cell may be used to eradicate or kill BCMA+CD19+ or BCMA+CD19- or BCMA-CD19+ populations.

The present disclosure further discloses a compound CAR construct with enhanced potency of anti-myeloma cell activity against cells co-expressing target antigens, and yet retains sensitivity to tumor cells only expressing one antigen. In addition, each CAR of the compound CAR includes one or two co-stimulatory domains and exhibits potent killing capability in the presence of the specific target.

Without wishing to be bound by theory, it is believed that co-expression of IL-15/IL-15sushi or IL-15/IL-15sushi anchor or 4-1BBL with BCMA-CD19 cCAR provides long-term durable remission in patients by increasing the sensitivity of CAR recognition of target myeloma cells or recruiting innate immune cells to myeloma cells.

CD33b-CLL-1 cCAR or CLL-1-CD33b cCAR

Generation of CD33b-CLL-1 cCAR (CD33-CLL-1 or CLL-1-CD33b cCAR)

A cCAR contains two units of CARs, CD33b CAR and CLL-1 CAR targeting tumor cells expressing CD33 and CLL-1, respectively. CD33b CAR and CLL-1 CAR were used to construct a cCAR shown in FIG. 92. The construct comprises a SFFV promoter driving the expression of multiple modular units of CARs linked by a P2A peptide. Upon cleavage of the linker, the cCARs split and engage upon targets expressing CD33 and CLL-1. The activation domains of the construct included 4-1BB on the CD33b (CD33) CAR unit and a CD28 on the CLL-1 CAR unit. This CD33b-CLL-1 cCAR was designed to delete myeloid leukemic cells including leukemic stem cells.

At the present, therapies for MDS and AML have focused on the leukemic blast cells because they are very abundant and clearly represent the most immediate problem for patients. Importantly, leukemic stem cells (LSCs) are quite different from most of the other leukemia cells ("blast" cells), and they constitute a rare subpopulation. While killing blast cells can provide short-term relief, LSCs, if not destroyed, will always re-grow, causing the patient to relapse. It is imperative that LSCs be destroyed in order to achieve durable cures for MDS disease. Unfortunately, standard drug regimens are not effective against MDS or AML LSCs. Therefore, it is critical to develop new therapies that can specifically target both the leukemic stem cell population and the bulky leukemic population. The compound CAR disclosed in the present disclosure target both populations and is embodied herein.

In one aspect of the present disclosure, CLL-1 antigen is one of the targets for cCAR therapy. C-type lectin-like-1 (CLL-1) is also known as MICL, CLEC12A, CLEC-1 and DCAL2. CLL-1 is a glycoprotein receptor and is expressed in hematopoietic cells. CLL-1 is absent on uncommitted CD34+/CD38− or CD34+/CD33− stem cells but present on subsets of CD34+/CD38+ or CD34+/CD33+ progenitor cells (Bakker et al, 2004). In addition, CLL-1 is not expressed in any other tissue.

CLL-1 expression is seen in acute myeloid leukemia (AML) blasts and leukemic stem cells. CLL-1 is expressed in a variety of leukemias including myelomonocytic leukemia (M4), acute monocytic leukemia (M5), acute promyelocytic leukemia (M3), chronic myeloid leukemia (CML), chronic myeloproliferative neoplasms and myelodysplastic syndromes (MDS).

CLL-1 is expressed on a subset of leukemic cells related to leukemic stem cells (LSCs), the ablation of which is essential in preventing disease refractoriness and relapse.

CD33 (Siglec-3) is a myeloid lineage-specific antigen expressed on early myeloid progenitors, most monocytic cells and approximately 90% of AML blasts, but absent on normal HSCs.

In one aspect of the present disclosure, CD33 antigen is one of the targets for cCAR therapy. CD33 is a transmembrane receptor expressed on 90% of malignant cells in acute myeloid leukemia. Thus, according to the present disclosure, CLL-1 and CD33 target antigens are particularly attractive from a safety standpoint.

In accordance with the present disclosure, the compound CD33-CLL1 CARs may be highly effective for therapeutic treatment of chronic myeloid leukemia (CML) population. In chronic myeloid leukemia (CML), there is a rare subset of cells that are CD34+CD38-. This population is considered as comprised of LSCs. Increased number of LSCs is associated with the progression of the disease. A small-molecule Bcr-Abl tyrosine kinase inhibitor (TKI) is shown to significantly improve the overall survival in CP-CML patients. However, LSCs are thought to be resistant to TKI therapy. A novel therapy targeting CML resistant LSCs is urgently needed for treatment of CML and the novel therapy is embodied in the compound CD33CLL-1 CAR disclosed in the present disclosure. CLL-1 expression is high in the CD34+CD38-population. In accordance with the present disclosure, the compound CD33CLL-1 CARs is highly effective for therapeutic treatment of this population.

In one embodiment of the present disclosure, leukemic cells expressing both CD33 and CLL-1 in the cCAR are used as a therapeutic treatment. CD33 is expressed on cells of myeloid lineage, myeloid leukemic blasts, and mature monocytes but not normal pluripotent hematopoietic stem cells. CD33 is widely expressed in leukemic cells in CML, myeloproliferative neoplasms, and MDS.

Since a significant number of patients with acute myeloid leukemia (AML) are refractory to standard chemotherapy regimens or experience disease relapse following treatment (Burnett 2012), the development of CAR T cell immunotherapy for AML has the potential to address a great clinical need. In the majority of these patients, leukemic cells express both CLL-1 and CD33, giving broad clinical applicability to the compound CD33CLL-1 CAR disclosed herein. Thus, the present disclosure discloses a novel multiple cCAR T/NK cell construct comprising multiple CARs targeting multiple leukemia-associated antigens, thereby offsetting antigen escape mechanism, targeting leukemia cells, including leukemic stem cells, by synergistic effects of co-stimulatory domain activation, thereby providing a more potent, safe and effective therapy.

In further embodiments, the present disclosure provides a method of eradicating or killing leukemic stem cells (LSCs) or bulk leukemic cells expressing CLL-1 or CD33, or both.

In this embodiment, a T or NK engineered cell having a CD33 unit and a CLL-1 unit is administered to a patient in need thereof.

In further embodiments, the compound CAR in a T or NK cell may be used to eradicate or kill CD34+CD38− leukemic stem cells or bulk leukemic cells expressing CLL-1 or CD33 or both.

The present disclosure further discloses a compound CAR construct with enhanced potency of anti-tumor activity against cells co-expressing target antigens, and yet retains sensitivity to tumor cells only expressing one antigen. In addition, each CAR of the compound CAR includes one or two co-stimulatory domains and exhibits potent killing capability in the presence of the specific target.

Without wishing to be bound by theory, it is believed that co-expression of IL-15/IL-15sushi or IL-15/IL-15sushi anchor or 4-1BBL with CD33-CLL-1 cCAR provides long-term durable remission in patients by increasing the sensitivity of CAR recognition of target cancer cells or recruiting innate immune cells to cancer cells.

In some embodiments, the disclosed disclosure also comprises methods of constructing CD33b-CLL-1 cCAR (FIG. 92).

The example is described below.

Example

An engineered CD33b-CLL-1 cCAR cell was prepared in accordance with the present disclosure.

Cell killing assay is performed and targeted cells expressing CD33 or CLL-1 or both are lysed by CD33b-CLL-1 cCAR In some embodiments, the disclosed disclosure also comprises methods of improving the CD33b-CLL-1 cCAR therapeutic activity. The example is described below.

Example

An engineered CD33b-CLL-1 cCAR cell was prepared in accordance with the present disclosure.
Cell Killing Assay is Performed Targeted Cells killing by CD33-CLL-1 cCAR is improved when co-expressed with 4-1BBL or IL-15/IL-15sushi or IL-15/IL-15RA or IL-15/IL-15sushi anchor.

In one embodiment, the engineered cell includes a CLL-1-3233-CD33b cCAR composing of a first chimeric antigen receptor polypeptide having a CLL-1 antigen recognition domain and second chimeric antigen receptor polypeptide having a CD33 recognition domain. In one embodiment, this engineered cell includes a polypeptide of SEQ ID NO. 154 and corresponding polynucleotide of SEQ ID NO. 155.

In one embodiment, the engineered cell includes a CLL-1-3738-CD33b cCAR composing of a first chimeric antigen receptor polypeptide having a CLL-1 antigen recognition domain and second chimeric antigen receptor polypeptide having a CD33 recognition domain. In one embodiment, this engineered cell includes a polypeptide of SEQ ID NO. 156 and corresponding polynucleotide of SEQ ID NO. 157.

In one embodiment, the engineered cell includes a CLL-1-3738-2G CAR composing of a first chimeric antigen receptor polypeptide having a CLL-1 antigen recognition domain. In one embodiment, this engineered cell includes a polypeptide of SEQ ID NO. 152 and corresponding polynucleotide of SEQ ID NO. 153.

In one embodiment, the engineered cell includes a CLL-1-3233-2G CAR composing of a first chimeric antigen receptor polypeptide having a CLL-1 antigen recognition domain. In one embodiment, this engineered cell includes a polypeptide of SEQ ID NO. 150 and corresponding polynucleotide of SEQ ID NO. 151.

In one embodiment, the CLL-1 antigen recognition domain includes SEQ ID NO. 194 and 161.

CD4-CD123 cCAR or CD4-CLL-1 cCAR

Generation of CD4-CD123 cCAR or CD4-CLL-1 cCAR

A cCAR contains two units of CARs, CD4 CAR and CD123 or CLL-1 CAR targeting tumor cells expressing CD4 and CD123 or CLL-1. A CD4 CAR unit and CD123CAR unit were used to construct a cCAR shown in FIG. 93. A similar strategy can be used to generate CD4-CLL-1 cCAR. The construct comprises a SFFV promoter driving the expression of multiple modular units of CARs linked by a P2A peptide. Upon cleavage of the linker, the cCARs split and engage upon targets expressing CD4 and 123. The activation domains of the construct included 4-1BB on the CD4 CAR unit and a CD28 on the CD123 CAR unit. This CD4-CD123 cCAR was designed to delete AML cells including leukemic stem cells.

CD4 is expressed in blastic plasmacytoid dendritic cell neoplasms, granulomatous histiocytic lymphoma/sarcoma, acute myeloid leukemia, particularly M4 and M5

Therapeutic Applications of CD4-CD123 cCAR or CD4-CLL-1 cCAR

In accordance with the present disclosure, the compound CD4-CD123 CARs may be highly effective for therapeutic treatment of AML population.

CD4 is expressed in AML, especially in M4 and M5 subtypes (65.0% and 78.3%, respectively), and is not expressed in non-hematopoietic cells (Miwa H, 1998). In AML, there is a rare subset of cells that are CD34+CD38-. This population is considered as comprised of LSCs that express CD123 or CLL-1.

A novel therapy targeting AML resistant LSCs is urgently needed for treatment of AML and the novel therapy is embodied in the compound CD4CD123 or CD4CLL-1 cCAR disclosed in the present disclosure. CLL-1 expression is high in the CD34+CD38- population. In accordance with the present disclosure, the compound CD4CD123 or CD4CLL-1 cCARs is highly effective for therapeutic treatment of this population.

In one embodiment of the present disclosure, leukemic cells expressing both CD4 and CD123 or CLL-1 in the cCAR are used as a therapeutic treatment. Both CD4 and CD123 are expressed in blastic plasmacytoid dendritic cell neoplasms.

Since a significant number of patients with acute myeloid leukemia (AML) are refractory to standard chemotherapy regimens or experience disease relapse following treatment (Burnett 2012), the development of CAR T cell immunotherapy for AML has the potential to address a great clinical need. In the majority of these patients, leukemic cells express CD4, CD123 and CLL-1, giving broad clinical applicability to the compound CD4-CD123 or CD4-CLL-1 cCAR disclosed herein. Thus, the present disclosure discloses a novel multiple cCAR T/NK cell construct comprising multiple CARs targeting multiple leukemia-associated antigens, thereby offsetting antigen escape mechanism, targeting leukemia cells, including leukemic stem cells, by synergistic effects of co-stimulatory domain activation, thereby providing a more potent, safe and effective therapy.

In further embodiments, the present disclosure provides a method of eradicating or killing leukemic stem cells (LSCs) or bulk leukemic cells expressing CD4, or CD123 or CLL-1 or all three. In this embodiment, a T or NK engineered cell having a CD4 unit and a CD123 or CLL-1 unit is administered to a patient in need thereof.

In further embodiments, the compound CAR in a T or NK cell may be used to eradicate or kill CD34+CD38- leukemic stem cells or bulk leukemic cells expressing CD123 or CLL-1 or CD4 or all In further embodiments, the compound CAR in a T or NK cell may be used to eradicate or kill blastic plasmacytoid dendritic cells expressing CD4 or CD123 or both.

In some embodiments, the disclosed disclosure also comprises methods of constructing CD4-CD123 cCAR (FIG. 93).

The example is described below.

Example

An engineered CD4-CD123 cCAR cell was prepared in accordance with the present disclosure.

Cell killing assay is performed and targeted cells expressing CD4 or CD123 or both are lysed by CD4-CD123cCAR In some embodiments, the disclosed disclosure also comprises methods of improving the CD4-CD123 cCAR therapeutic activity. The example is described below.

Example

An engineered CD4-CD123 cCAR cell was prepared in accordance with the present disclosure.

Cell Killing Assay is Performed

In present disclosures, CD4 or CD123 or both are the targets for CD4-CD123 cCAR or CD4-CD123b cCAR therapy.

In one embodiment, the engineered cell includes CD4-CD123 cCAR composing of a first chimeric antigen receptor polypeptide having a CD4 antigen recognition domain and second chimeric antigen receptor polypeptide having a CD123 recognition domain. In one embodiment, this engineered cell includes a polypeptide of SEQ ID NO. 146 and corresponding polynucleotide of SEQ ID NO. 147.

In present disclosures, CD4 or CLL-1 or both are the targets for CD4-CLL-1 cCAR or CLL-1-CD4 cCAR therapy.

Killing of Targeted Cells by CD4-CD123 cCAR is improved when co-expressed with 4-1BBL or IL-15, IL-15/IL-15sushi or IL-15/IL-15RA or IL-15/IL-15sushi anchor.

In some embodiments, a compound CAR targets antigens that can be selected from at least one of this group, but not limited to, ROR1, PSMA, PSCA (prostate stem cell antigen), MAGE A3, Glycolipid, glypican 3, F77, GD-2, WT1, CEA, HER-2/neu, MAGE-3, MAGE-4, MAGE-5, MAGE-6, alpha-fetoprotein, CA 19-9, CA 72-4, NY-ESO, FAP, ErbB, c-Met, MART-1, MUC1, MUC2, MUC3, MUC4, MUC5, CD30, EGFRvIII, CD33, CD123, CLL-1, CD70, immunoglobin kappa and lambda, CD38, CD52, CD19, CD20, CD22, CD38, BCMA, CS1, BAFF receptor, TACI, CD3, CD4, CD8, CD5, CD7, CD2, and CD138. The target antigens can also include viral or fungal antigens, such as E6 and E7 from the human papillomavirus (HPV) or EBV (Epstein Barr virus) antigens.

Production of CD4-3G-IL-15/IL-15sushi and CD4-3G-IL-15/IL15sushi Anchor CAR NK Cells.

CD4-3G-IL-15/IL-15sushi CAR was a CD4-3G (third generation CD4 CAR, CD4-3G) CAR armored with a secreting IL-15/IL-15sushi complex, and CD4-3G-IL-15/IL-15sushi anchor CAR was CD4-3G CAR (third generation CD4 CAR, CD4-3G) equipped with an IL-15/IL-15sushi anchor (FIGS. 94 and 95).

NK-92 cells were transduced with CD4-3G-IL-15/IL-15 sushi or CD4-3G-IL-15/IL15sushi anchor CAR lentiviruses After 5 day incubation, cells were harvested and incubated with goat anti-mouse F(Ab')2 at 1:250 for 30 minutes. Cells were washed, suspended and stained with streptavidin-PE for 30 minutes for analysis of surface CAR expression. Transduced cells were expanded and then sorted for CAR expression. CD4CAR surface expression levels were shown in FIG. 97A. CD4C-3G- (78.3%), CD4-3G-IL-15/IL-15sushi (97.1%) or CD4-3G-IL-15/IL-15 anchor CAR (93.4%) transduced NK92 cells were compared to untransduced-NK92 cells in terms of surface CAR expression (FIG. 97A).

The same strategy described above was used to generate CD19-IL-15/IL-15sushi CAR, CD19-IL-15/IL-15sushi anchor CAR, CD19-IL-15 CAR, CD33-IL-15/IL-15sushi CAR, CD33-IL-15/IL-15sushi anchor CAR, CD33-IL-15 CAR, BCMA-IL-15/IL-15sushi CAR, BCMA-IL-15/IL-15sushi anchor CAR and BCMA-IL-15 CAR, CD20-IL-15/IL-15sushi CAR, and CD22-IL-15/IL-15sushi CAR (FIGS. 94, 95 and 96).

In one embodiment, the engineered cell includes CD19 CAR linked to IL15/IL-15sushi via the P2A cleavage sequence. A polypeptide providing this embodiment includes SEQ ID No. 126, 174 and corresponding polynucleotide sequence SEQ ID No. 127 and 175.

In one embodiment, the engineered cell includes CD19 CAR linked to 4-1BBL via the P2A cleavage sequence. A polypeptide providing this embodiment includes SEQ ID No. 164 and corresponding polynucleotide sequence SEQ ID No. 165.

In one embodiment, the engineered cell includes CD19 CAR linked to IL-15 (with IL-2 signal peptide) via the P2A cleavage sequence. A polypeptide providing this embodiment includes SEQ ID No. 211 and corresponding polynucleotide sequence SEQ ID No. 212.

In one embodiment, the engineered cell includes CD33 CAR linked to IL-15 (with IL-2 signal peptide) via the P2A cleavage sequence. A polypeptide providing this embodiment includes SEQ ID No. 209 and corresponding polynucleotide sequence SEQ ID No. 210.

In one embodiment, the engineered cell includes BCMA CAR linked to IL-15 (with IL-2 signal peptide) via the P2A cleavage sequence. A polypeptide providing this embodiment includes SEQ ID No. 207 and corresponding polynucleotide sequence SEQ ID No. 208.

Secreting IL-15/IL-15sushi or IL-15/IL-15sushi Anchor Substitutes for IL-2 in NK Cell Survival and Expansion.

Sorted NK92 cells stably transduced with CD4-3G-IL-15/IL-15sushi or CD4-3G-IL15/IL-15 anchor CAR (see FIG. 97A) can expand at a similar rate in the absence of IL-2 as compared to NK92 cells stably transduced with CD4-3G CAR or GFP lentiviruses, which could not grow (data not shown). This study pin-points the importance of co-expression functional complex of IL-15/IL-15sushi or IL-15/IL-15 anchor in promoting CAR transduced-NK-92 cell growth.

We then tested effect of secreting IL-15/IL-15sushi and IL-15/IL-15sushi anchor on non-transduced neighboring cells. Sorted NK-92 cells stably expressing CD4-3G or CD4-3G-IL-15/IL-15sushi or CD4CAR-3G-IL-15/IL-15sushi anchor CAR were mixed in a 50:50 ratio with GFP+ NK-92 cells. These cells were co-cultured either with IL-2 added or no IL-2. Total cell counts were calculated throughout the experiment (up to Day 10) for NK-92 cells co-cultured with or without IL2. CD4-3G CAR- or GFP-expressing NK cells cultured without IL-2 died by Day 4 or 5, while secreting CD4-3G-IL-15/IL-15sushi-expressing NK 92 cells cultured without IL-2 could survived and expanded over Day 10 (FIG. 97B), indicating that secreted IL-15/IL-15sushi could substitute for IL-2. Co-culture CD4-3G-IL-15/IL-15sushi anchor CAR-transduced NK92 cells exhibited similar proliferation compared to co-cultured with CD4-3G-IL-15/IL-15sushi CAR-NK92 cells (FIG. 97B).

Furthermore, we could demonstrate that NK cells secreting IL-15/IL-15sushi could aid in the survival and expansion of neighboring GFP-transduced NK-92 cells and IL-15/IL-15sushi transduced NK cells in a co-culture (FIGS. 97C and 97D). The percentage of GFP-positive cells had slightly reduced when they were co-cultured with CD4-3G-IL-15/IL-15sushi CAR transduced-NK92 cells during 10-day co-culture. In contrast, the percentage of GFP-positive cells gradually dropped and died by day 10 when they were co-cultured with CD4-3G-IL-15/IL-15sushi anchor CAR transduced-NK92 cells during 10-day co-culture (FIGS. 97C and 97D).

To further determine if this effect was due to secreting protein alone, or an interaction between co-cultured cells, we devised an experiment in which the GFP NK cells were cultured in a chamber above the cultured CD4-3G CAR or CD4-3G-IL-15/IL-15sushi or CD4-3G-IL-15/IL-15sushi NK cells, or non-transduced NK-92 cells. In this situation, only proteins and not cells could pass between the membrane separating the two cultures. While NK92 cells in the upper chamber above NK-92 cells or NK92 cells in the upper chamber above CD4-3G CAR transduced NK92 cells had died by Day 5 or 6, the NK92 cells above the CD4IL-15/IL-15sushi CAR NK92 cells had survived and expanded by over Day 10 (FIG. 97E), thereby indicating that it was the IL-15/IL-15sushi protein secreted by the CD4-3G-IL-15/IL-15sushi NK92 cells which had kept them alive, and not direct cell-to-cell contact. In this model, the upper chamber represents the tumor microenvironment, in which the survival of T cells or NK cells is improved by the secretion of IL-15/IL-15sushi from the CD4-3G-IL-15/IL-15sushi NK92 cells. A similar experiment was performed using CD4-3G-IL-15/IL-15sush anchor CAR transduced NK92 cells. NK92 cells in the upper chamber above CD4-3G/IL-15/IL-15sush anchor CAR transduced NK92 cells had died by Day 9 or 10 (FIG. 97E).

In summary, these studies indicate that secreting IL-15/IL-15sushi complexes have a profound effect on CAR cells and their neighboring non-CAR cells. In contrast, IL-15/IL-15sushi anchor had a similar effect on CAR cells to secreting IL-15/IL-15sushi but its effect on neighboring non-CAR cells was limited.

Compare the Effect of Secreting IL-15/IL-15sushi, IL-15/IL-15sushi Anchor and Secreting IL-15 with IL-2 Signal Peptide on CAR Efficacy In Vivo The functions of secreting IL-15/IL-15sush, IL-15/IL-15 anchor and secreting IL-15 with an IL-2 signal peptide on CARs were further tested in a mouse model. Luciferase-expressing Jurkate cells ($1 \times 10^6$ cells) were injected intravenously (day 1) at 24 h later after sub-lethal irradiation. About 50% Jurkate cells expressed CD4. On days 6 and 9, $5 \times 10^6$ control GFP-, CD4-3G-, CD4-3G-IL-15/IL-15sush, IL-15/IL-15sushi anchor and secreting IL-15 (with IL-2 signal peptide) CAR-NK92 cells were intravenously injected into each mouse (n=2 for each group). One CD4-3G-IL-15/IL-15sushi NK92 treated mouse was dead due to injection procedure (clumps of NK92 cells). All CD4-3G CARs equipped with IL-15/IL-15shshi, CD-3G-IL-15sush anchor and IL-15 (with IL-2 signal peptide) did displayed more potent anti-leukemic effects on Jurkate cells than GFP or CD4-3G control (FIG. 97F). Among these CARs, CD4-3G CAR equipped with IL-15/IL-15 sushi provided a better efficacy than other versions of CD4-3G CARs. Interestingly, CD4-3G-IL-15/IL-15sushi anchor-NK92 treated mice showed gradually less tumor burden compared to GFP control (FIG. 97F).

The Effect of 4-1BBL on NK Cell Survival and Expansion.

We also determined the effect of 4-1BBL on NK cell survival and expansion and compared to that of controls. In this experiment, CD45b-28 CAR NK cells targeting CD45 antigen was generated as described in FIG. 57. CD45b-28 CAR were armored with 4-1BBL (CD45b-28-4-1BBL) or IL-15/IL-15 sushi (CD45b-28-IL-15/IL-15sushi). Surface CD45b-CAR expression levels on sorted CD45b-28-, sorted CD45b-28-4-1BBL or sorted CD45b-28-IL-15/IL-15sushi CAR transduced NK92 cells were determined using flow cytometry analysis (FIG. 98A)

CD45b-28-4-1BBL CAR, CD45b-28 CAR or GFP-expressing NK cells cultured without IL-2 start to die by Day 4, while CD45b-28-IL-15/IL-15sushi-expressing NK cells cultured without IL-2 expanded (FIG. 98B). These experiments demonstrated that secreted IL-15/IL-15sushi could substitute for IL-2 but 4-1BBL could not.

CD45b-28-NK92 Cells could not Demonstrate Significant Anti-Leukemic Effect on the MOLM-13 (Human Acute Monocytic Leukemia) Cell Line in an In Vivo Xenograft Mouse Model.

Luciferase-expressing MOLM-13 cells ($1 \times 10^6$ cells) were injected intravenously (day 1) at 24 h later after sub-lethal irradiation. On days 4 and 5, $5 \times 10^6$ control GFP- or CD45b-28-NK92 cells were intravenously injected into each mouse. Tumor burden of dorsal side was measured using IVIS imaging system at days 3, 7 and 9. Both of control NK92 cells treated mice and CD45b-CAR-28-NK92 treated mouse did not show any difference in the tumor burden by IVIS imaging analysis (FIG. 98C).

CD45b-28-4-1BBL and CD45b-28-IL-15/IL-15sushi CAR NK Cells Exhibit Robust and Persistent Anti-Tumor Activity In Vivo To further evaluate the 4-1BBL and IL-15/IL-15sushi CAR function, we created a leukemic mouse model. Luciferase-expressing MOLM-13 cells ($1 \times 10^6$ cells) were injected intravenously (day 1) at 24 h later after sub-lethal irradiation. MOLM-13 is a very aggressive AML cell line. On days 4 and 5, $5 \times 10^6$ control GFP-, CD45b-28-4-1BBL- or CD45b-28-IL-15/IL-15sushi CAR NK92 cells were intravenously injected into each mouse (n=2 for each group). At day 5, one control-NK92 treated mouse and one CD45b-28-IL-15/IL-15sushi NK92 treated mouse were dead due to cell injection. Tumor burden of dorsal side and ventral side was measured using IVIS imaging system at days 3, 7 and 9.

Compared to control NK92 cells or CD45b-28 NK92 cells (FIG. 98C) treated mice, CD45b-28-4-1BBL-NK92 cells and CD45b-CAR-28-IL-15/IL-15sushi-NK92 cells displayed robust anti-tumor activity (FIG. 98D). Tumor reduction by more than 90% was seen in MOLM13 leukemic mice treated with ether CD45b-28-IL-15/IL-15sushi or CD45b-28-4-1BB (FIG. 98E) compared to control mice. Although 4-1BBL was unable to provide survival or expansion for NK-92 cells in vitro unlike secreting IL-15/IL-15sushi, 4-1BBL could exhibit as a powerful enhancer for CAR anti-tumor function in vivo (FIGS. 98D and 98E). Without wishing to be bound by theory, it is believed that CAR (super CAR) is more powerful when incorporating both 4-1BBL and IL-15/IL-15sushi (FIG. 98F). Without wishing to be bound by theory, it is also believed that CAR (super CAR) is more powerful when incorporating both 4-1BBL and IL-15/IL-15sushi anchor (FIG. 98G).

In one embodiment, the engineered cell includes CD45 CAR (super CAR) linked to 4-1BBL and IL-15/IL-15sushi via the P2A and T2A cleavage sequences. A polypeptide providing this embodiment includes SEQ ID No. 134 and corresponding polynucleotide sequence SEQ ID No. 135.

In some embodiments, the target antigens for a super CAR can include at least one of this group, but not limited to, ROR1, PSMA, PSCA, MAGE A3, Glycolipid, glypican 3, F77, GD-2, WT1, CEA, HER-2/neu, MAGE-3, MAGE-4, MAGE-5, MAGE-6, alpha-fetoprotein, CA 19-9, CA 72-4, NY-ESO, FAP, ErbB, c-Met, MART-1, MUC1, MUC2, MUC3, MUC4, MUC5, CD30, EGFRvIII, CD33, CD123, CLL-1, immunoglobin kappa and lambda, CD38, CD52, CD19, CD20, CD22, CD38, BCMA, CS1, BAFF receptor, TACI, CD3, CD4, CD8, CD5, CD7, CD2, CD70 and CD138. The target antigens can also include viral or fungal antigens, such as E6 and E7 from the human papillomavirus (HPV) or EBV (Epstein Barr virus) antigens.

CD45b-28 Armored with IL-15/IL-15sushi (CD45b-28-IL-15/IL-15sushi)-NK92 Cells Demonstrate a More Profound Anti-Leukemic Effect on the Jurkat (Human Acute T Cell Leukemia) Cell Line in an In Vivo Xenograft Mouse Model as Compared to CD45b-28 NK92 Cells.

Luciferase-expressing Jurkat cells ($1 \times 10^6$ cells) were injected intravenously (day 1) at 24 h after sub-lethal irradiation. On day 4 and 7, $5 \times 10^6$ control GFP- or CD45b-CAR-28- or CD45b-CAR-28-IL-15/IL-15sushi-NK92 cells were intravenously injected into each mouse. Tumor burden of dorsal side and ventral side was measured using IVIS imaging system at days 3, 6, 9, 11, 14 and 20. Compared to control NK92 cells, CD45b-28-NK92 cells showed no significant anti-tumor activity against Jurkat in mice. However, CD45b-28 CAR equipped with IL-15/IL-15 sushi (CD45b-28-IL-15/IL-15 sushi) on NK cells demonstrated a profound anti-tumor activity in mice (FIGS. 99A, 99B, and 99C). CD45b-28 CAR NK cells in leukemic mice showed no significant effect in the control of tumor growth while CD45b-28-IL-15/IL-15sushi CAR NK cells increased to over 90% in terms of tumor burden reduction on day 20 (FIG. 99C). This study indicates that secreting IL-15/IL-15sushi has a more remarkable effect on the CAR function against targeted tumor cells in vivo than a CAR without equipped with IL-15/IL-15sushi.

Adoptive CAR T cell immunotherapy involves the ex vivo expansion and reinfusion of CAR T cells, and is dependent on CAR T cell engraftment and persistence for efficacy.

In some embodiments, the disclosed disclosure comprises methods and compositions of shortening CAR T cell culture time by equipped with an enhancer including, but limited to, IL-15/IL-15sushi anchor, secreting IL-15/IL-15sushi and secreting IL-15 or IL-18 or IL-7 or IL-21 or IL-12

In some embodiments, the disclosed disclosure comprises methods and compositions of shortening CAR T cell culture time by equipped with an enhancer selected from at least one of IL-15/IL-5sushi anchor, secreting IL-15/IL-5sushi and secreting IL-15 or IL-18 or IL-7 or IL-21 or IL-12.

In some embodiments, IL-15/IL-15sushi anchor, secreting IL-15/IL-15sushi and secreting IL-15 can improve CAR T cell expansion in vitro In some embodiments, IL-15/IL-15sushi anchor, secreting IL-15/IL-15sushi and secreting IL-15 can shorten harvesting time for CAR T cell culture and provide high quality of CAR cells for therapy in terms of persistency and engraftment.

CD19 CAR and BCMA CAR Equipped with an Enhancer(s)

While initial remission rates of approximately 90% are commonly seen in patients with B-ALL using CD19CAR, most patients relapse within a year. The relapse is at least in part due to antigen escape. Thus, more effective CAR T cell treatments to prevent relapse are urgently needed.

CD19b-IL-15/IL-15sush CAR is a CD19 CAR (targeting CD19 antigen) equipped with secreting IL-15/IL-15sushi (FIG. 100A).

CD19b-IL-15/IL-15sushi CAR T or NK cells targeting tumor cells, could be a carrier to deliver an enhancer to the tumor microenvironment. CD19b CAR T or NK cells in tumor microenvironment target tumor cells, binding to the CAR targeting antigen (CD19) and triggering lysis tumor cells and massive secretion of soluble IL-15/IL-15sush fusion from the expansion of CD19b CAR T cells and NK cells.

In some embodiments, secreting IL-15/IL-15sushi can improve CD19b CAR T cell expansion in vitro or in vivo. In a further embodiment, secreting IL-15/IL-15sushi can enhance CAR T or NK cell persistency in vivo.

In some embodiments, the secreted IL-15/IL-15sushi protein can be involved in trafficking of other T cells, dendritic cells, macrophages and NK cells to the tumor microenvironment, which then lyse the tumor cells by supplementing the defect that CD19b CAR T or NK cells are unable to eliminate non-targeting cancer cells to prevent antigen escape or disease relapses.

In some embodiments, secreting IL-15/IL-15sush from CD19b CAR in tumor sites can overwhelms the PD-L1 ability to suppress the immune response and increase CAR T or NK cell persistency.

In some embodiments, IL-15/IL-15sushi anchor, secreting IL-15/IL-15sushi and secreting IL-15 can improve CAR T cell expansion in vitro and in vivo.

In some embodiments, IL-15/IL-15sushi anchor, secreting IL-15/IL-15sushi and secreting IL-15 can shorten harvesting time for CD19 CAR T cell culture and provide high quality of CD19b CAR cells for therapy in terms of persistency and engraftment.

In some embodiments, IL-15/IL-15sushi anchor, secreting IL-15/IL-15sushi and secreting IL-15 can shorten harvesting time for any CAR T cell culture and provide high quality of CD19b CAR cells for therapy in terms of persistency and engraftment.

In some embodiments, IL-15/IL-15sushi anchor, secreting IL-15/IL-15sushi and secreting IL-15 can improve CD19b CAR T cell therapeutic outcomes and prevent disease relapses.

Examples

Generation of CD19b CAR and CD19b-IL-15/IL-15sushi CAR

CD19b CAR was constructed as a modularized signaling domain containing: a leader sequence, scFv against CD19 antigen, a hinge domain (H), a transmembrane domain (TM), a co-stimulatory domains (4-1BB) and the intracellular signaling domain CD3 zeta (see above). CD19b-IL-15/IL-15sushi is a CD19b CAR armored with IL-15/IL-15sushi (FIG. 100A).

Both CD19b CAR and CD19b-IL-15/IL-15sushi CAR could Efficiently Eliminate Lymphoma or Leukemia Cells Expressing CD19.

To assay the cytotoxic ability of CD19b and CD19b-IL15/IL15sushi CAR T-cells, we conducted co-cultures against CD19 positive Sp53 cells (Mantle cell line, a B cell lymphoma) for 24 hours. We found that both CD19b and CD19b-IL15/IL15sushi CAR T-cells potently lysed all Sp53 cells at 24 hours, with saturation in lysis reached at a low E:T ratio of 2:1. An example of leukemic cell lysis by CD19b-IL15/IL-15sush was shown in (FIG. 100B) and significant target cell ablation observed at E:T ratios as low as 1:1.

CD19b CAR Equipped with Secreting IL-15/IL-15sushi is More Potent in Elimination of Leukemic Cells than that without Secreting IL-15/IL-15sushi In Vivo.

Figure 100D:
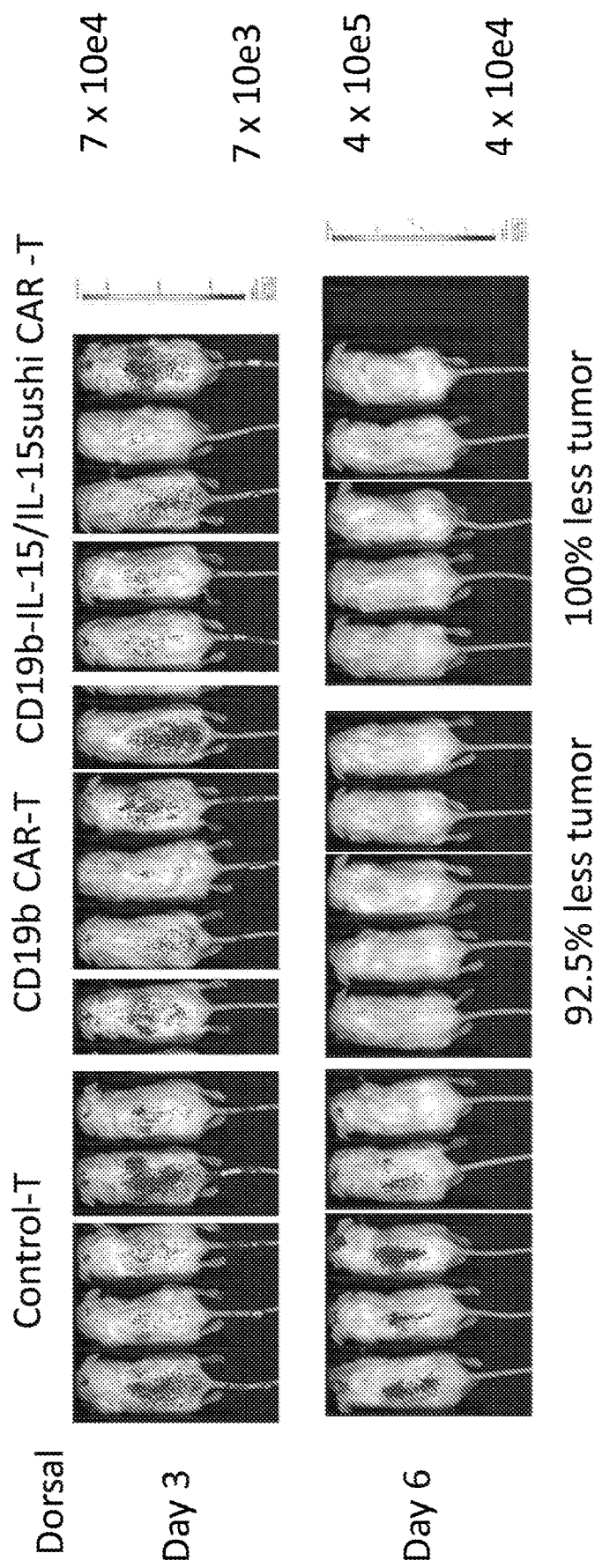
Figure 100E:
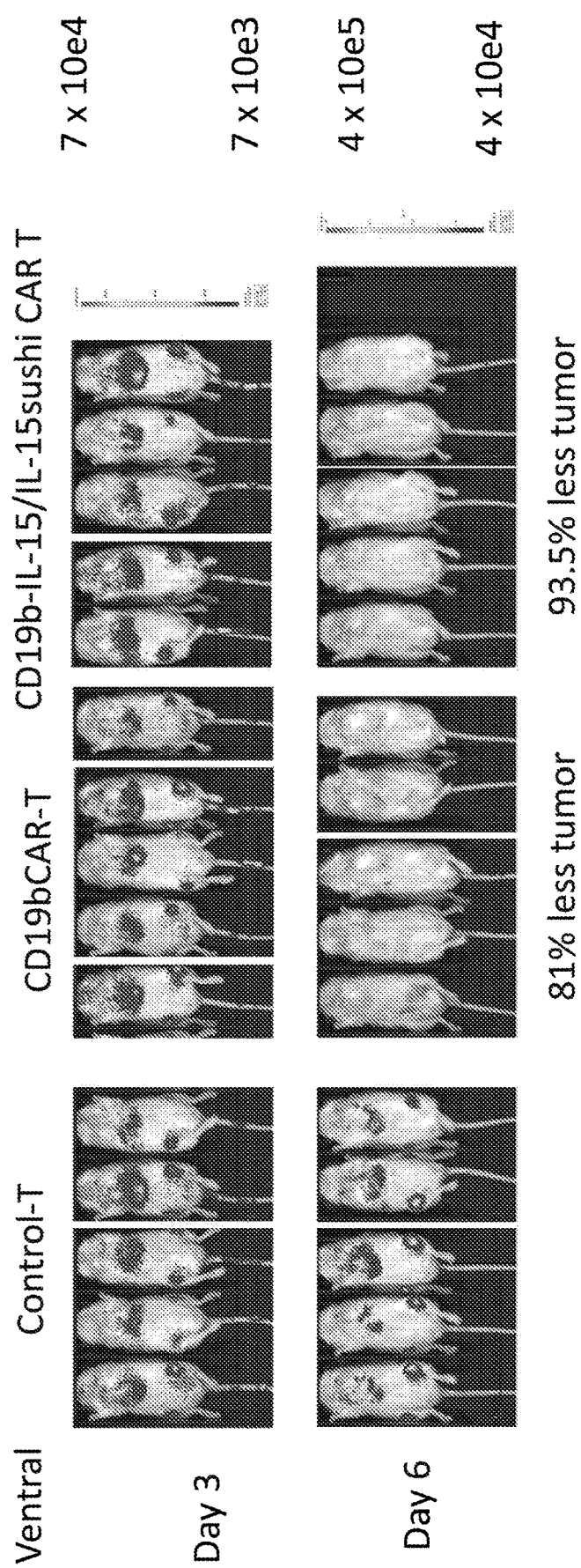

We next compared the potency of killing between CD19b CAR and CD19b-IL-15/IL-15sushi CAR in a mouse model system. NSG mouse model is an excellent model for this comparison. NSG xenogeneic mice were injected with Reh B-ALL leukemia cells stably expressing firefly-luciferase bio-luminescence. We injected on day 1, a tumor dose consisting of $0.5 \times 10^6$ Reh-Luc+ cells with followup IVIS imaging on day 3. On day 4, a dose of $7.5 \times 10^6$ effector T-cells (control, CD19b CAR, or CD19b-IL15/IL15sushi CAR) was injected with followup IVIS conducted on day 6. We found that both CD19b based CARs exhibited profound anti-tumor activity against Reh cells and could deplete ~80-100% efficiency for CD19b CAR based on IVIS analysis. IVIS analysis was performed in both dorsal field (FIG. 100 D) and ventral field (FIG. 100E). CD19b-IL15/IL15sushi CAR treated mice showed significantly up to 10% increased tumor burden reduction per luminescence quantification, consistent with our expectations that a CAR equipped with IL-15/IL-15sushi possesses more potent anti-tumor activity (FIGS. 100D and 100E).

Ablate CAR T Cells (Safety Switch)

In Vivo Effective Depletion of Infused CAR T Cells Following Treatment with CAMPATH (Alemtuzumab) In Vivo For clinical treatment using CAR T-cells against T-cell malignancies, establishment of safety methods to eliminate CAR T-cells from patients may be necessary after tumor depletion or in emergency cases due to unexpected side effects caused by CAR therapy. The elimination of CAR T cells from systemic circulation is necessary as quickly as possible. T cells express CD52 on surface, thereby we select CAMPATH as an ideal candidate drug.

CAMPATH (alemtuzumab) is the humanized monoclonal antibody against CD52 which is expressed on the surface of normal and malignant lymphocytes. CAMPATH is used clinically for treatment for lymphomas. The range of administration of CAMPATH is >3 mg/Day and maximum 30 mg/Day (90 mg/week). Our in vivo studies indicate that CAMPATH could be used as a "safety switch", which enables the elimination of CAR T cells within a few hours.

To assess the effect of CAR elimination by CAMPATH (alemtuzumab) treatment, we conducted in vivo procedures as described (FIGS. 101 and 102). We intravenously injected $10 \times 10^6$ CD4CAR T-cells into irradiated mice. Next day, we administrated 0.1 mg/kg of CAMPATH or PBS via IP injection for 3 mice of each group. After 6 and 48 hours following CAMPATH treatment, we collected peripheral blood from the mouse tail and determined presence of engineered CD4CAR T-cells by FACS analysis. FACS analysis showed more than 95% reduction of CD4CAR T cells in blood after CAMPATH administration at both 6 h and 48 h (FIGS. 101B and 101C). Five days following CAMPATH administration, we confirmed the lack of persistence of engineered CD4CAR T-cells in whole blood by FACS analysis. Engineered CD4CAR T cells were virtually depleted in blood, spleen, bone marrow and liver and data were summarized in FIG. 102. These findings support the use of CAMPATH as a useful strategy in acting as a safety trigger to deplete engineered CAR-T cells from circulation.

In some embodiments, the disclosed invention comprises methods and compositions of controlling the proliferation of T cells, for instance, CAR T cells or therapeutic T cells using CAMPATH. The methods further relate to compositions and methods for ablating CAR T cells using CAMPATH after tumor depletion or in emergency cases, for example, unexpected side effects caused by CAR Therapy.

In some embodiments, CD52 can be co-expressed in a CAR engineered cell or any CAR engineered cell and can be used as a "safety switch" for CAR therapy. In some embodiments, CAMPATH is an ideal drug for controlling CAR T cell proliferation. The preferred doses of CAMPATH is 6 mg/kg. Upon determining a need to administer CAMPATH, patients may be, for example, administered a single fixed dose of 6 mg/kg for Injection. The dose of CAMPATH is calculated individually for all patients based on the body weight. The dosage may vary according to the application, and may, in certain examples, be more in the range of 4 mg-30/kg, or in the range of 4 mg-60 mg/kg or 4 mg-100 mg/kg. In some cases, CAMPATH can be administrated to a subject with multiple doses to ensure the deletion of CAR T cells.

In one embodiment, the engineered cell includes CD7 CAR linked to IL-15/IL-15sushi or CD52 or both via the P2A and T2A cleavage sequences. A polypeptide providing this embodiment includes SEQ ID No. 159, 162 and corresponding polynucleotide sequence SEQ ID No. 160, 163, respectively.

GD2 (GD-2) or GD3 or GD2-GD3 CAR

Generation of the Third Generation of GD2 CAR and GD3

The anti-GD2 molecule is a modular design, comprising of a single-chain variable fragment (scFv) in conjunction with CD28 fused to the CD3zeta signaling domain to improve signal transduction. A strong spleen focus forming virus promoter (SFFV) was used for efficient expression of the GD2 CAR molecule on the hyman T cell surface and the CD8 leader sequence was incorporated into the construct. The anti-GD2 scFv was attached to the intracellular signaling domains via a CD8-derived hinge (H) and transmembrane (TM) regions. This GD2 CAR (GD2-28-2G CAR) construct was then cloned into a lentiviral plasmid (FIG. 106A).

A similar strategy was used to generate GD3 CAR (FIG. 106)

Characterization of GD2 CAR (GD2-28-2G CAR)

For preclinical characterization of GD2 CAR expression and function in T cells, human T cells were activated with anti-CD3 antibodies and IL-2, then transduced respectively with GD2 CAR and GFP control lentiviral supernatants. The T cells were then expanded for 4 to 7 days after transduction. Transduced cells were analyzed by flow cytometry for GD2 CAR surface expression (FIG. 107A). Flow cytometry analysis showed that ~48% of T-cells expressed the GD2 CAR (FIG. 107A).

Successful Generation of GD2 CAR T Cells Derived from PBMCs

Since autologous adoptive CAR T therapy is commonly used in the clinic, we then tested GD2 CAR T cells derived from PBMCs (peripheral blood mononuclear cells). Y79 retinoblastoma cell line was used for the cytotoxicity assay as GD2 is highly expressed in this cell line (FIG. 107B). PBMCs were activated and transduced with GD2 CAR lentiviruses. PBMC derived GD2 CAR cells were subsequently tested in their ability to ablate GD2 positive cancer cells, using Y79 retinoblastoma cell line.

GD2 CAR T Cells Efficiently Lyse GD2+ Tumor Cell Line in an In Vitro Assay

GD2 CAR T cells or control T cells were co-cultured with CMTMR-prelabeled Y79 cells cells at ratios ranging from 1:2 to 20:1, effector:target cells, for up to 72 hours. After 24 hours, cells were stained with mouse anti-human GD2, and CD56 and analyzed by flow cytometry. GD2 CAR T cells showed some lysis of target cells at the lowest 1:2 ratio, and lysis steadily increased with higher E:T ratios, with nearly complete depletion of Y79 cells at the 20:1 ratio (FIGS. 107C and 107D). After 72 hours, there was approximately 50% lysis achieved at the 1:2 ratio, and complete depletion at the 5:1 ratio and above (FIGS. 107E and 107F). The bar graph of FIG. 107G illustrates the robust and dose-dependent nature of target cell lysis by GD2-28 CAR T cells.

Generation of GD2 NK Cell CAR

NK-92 cells were transduced with GD2CAR or control vector lentiviral constructs (FIG. 10). GD2 CAR NK transduction efficiency was determined to be approximately 13%, as determined by flow cytometry (FIG. 108A). Next, live cell fluorescence-activated cell sorting (FACS) was used to further enrich for GD2 CAR positive NK-92 cells. Following sorting, collected GD2CAR NK cells were confirmed to be more than 95% Gd2 CAR positive (FIG. 108A). After FACS collection of GD2 CAR$^{high}$ cells, GD2 CAR expression levels remained consistently stable at 85-96% on NK92 cells during expansion of up to 10 passages, and following cryopreservation. Indeed, at the onset of co-culture experiments, expanded GD2 CAR NK cells still expressed CAR at 95%.

GD2 CAR NK-92 Cells Exhibit Anti-Tumor Activity Against Neuroblastoma Cell Line Y79

To assay the cytotoxic effect of a GD2 CAR transduced into a model N K-92 cells, we conducted co-culture assays in an escalating dosage model, Co-cultures were setup for 24 hours with cytotracker (CMTMR) labeled Y79 cells at E:T ratios of 2:1, 5:1, and 10:1. Flow cytometry analysis revealed that GD2 CAR NK-92 cells were able to exhibit increasing cytotoxicity as E:T was increased in a linear fashion. We expect that projecting E:T ratios further, GD2 CAR NK-92 cells may be able to exhibit potent lysis activity (FIGS. 10813 and 108C). Further experiments at higher E:T ratios and cytokine supplementation may reveal further information about anti-GD2 cytotoxicity.

GD2-GD3 Compound cCAR

Example

An engineered GD2-GD3 cCAR cell was prepared in accordance with the present disclosure (FIG. 109).

Cell killing assay is performed and targeted cells expressing GD2 or GD3 or both are lysed by GD2-GD3 cCAR.

In vivo anti-tumor activities, cell killing is performed in a xenogeneic mouse model and targeted cells expressing GD2 or GD3 or both are eliminated or suppressed by GD2-GD3 cCAR T or NK cells using methods described above.

SEQUENCE LISTING (252 sequences)

SEQ ID NO: 1 - protein, 830 aa, Artificial Sequence
  Synthetic Sequence
MALPVTALLLPLALLLHAARPDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 2 - DNA, 2509 bp, Artificial Sequence
  Synthetic Sequence
gcgatcgcatggccttaccagtgaccgccttgctcctgccgctggccttgctgctccacgccgccaggccggacatcgtgatgacccaaagccccgacagcctggccgtgagcctgggcgagagggtgaccatgaactgcaaaagcagccagtccctgctgtactccaccaaccagaagaactacctggcttggtatcaacagaagcccggacagagccccaagctgctgatctattgggccagcactagggaaagcggcgtgcccgataggttcagcggcagcgggagcggcacagacttcactctgaccattagcagcgtgcaggctgaggatgtggccgtctactactgccagcagtactacagctacaggacctttgggggcggaactaagctggagatcaagggaggggggggatccgggggaggaggctccggcggaggcggaagccaagtgcaactgcagcagagcggcccagaggtggtcaaacctggggcaagcgtgaagatgagctgcaaggctagcggctataccttcaccagctatgtgatccactgggtgaggcagaaaccaggacagggcctggactggatcggctacatcaacccctacaatgacggcaccgattatgacgaaaaattcaaggggaaggccaccctgaccagcgacaccagcacaagcaccgcctacatggagctgtccagcctgaggtccgaggacaccgccgtgtattactgtgccagggagaaggacaattacgccaccggcgcttggttcgcctactggggccagggcacactggtgacagtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 3 - protein, 995 aa, Artificial Sequence
  Synthetic Sequence
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPQIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKGGGGSGGGGSGGGGSQVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 4 - DNA, 3004 bp, Artificial Sequence
  Synthetic Sequence
gcgatcgcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccttaccagtgaccgccttgctcctgccgctggccttgctgctccacgccgccaggccgcagatcgtgctgagccagagccctgccatcctgtccgcaagcccaggcgagaaggtgaccatgacctgtagggccagcagctccgtgagctacatccactggtttcagcagaagcctggaagcagccctaagccctggatctacgccacaagcaatctggctagcggcgtgcccgtgaggttcagcggcagcgggagcgggaccagctacagcctgactatcagcagggtggaggccgaggacgccgccacatactactgccaacagtggacctccaacccacccacctttggaggagggacaaaactggagatcaaagggggcggagggtccggaggcggcggaagcgggggagggggaagccaggtccaactgcaacagcccggagcagaactggtcaaaccaggcgccagcgtgaagatgagctgcaaggccagcgggtacaccttcacttcctataacatgcactgggtgaagcagaccccaggaaggggcctggagtggatcggggcaatctatcccggcaacggcgacacaagctacaaccagaagttcaaggggaaagccactctgaccgccgacaagtccagctccaccgcctacatgcagctgagctccctgaccagcgaggacagcgccgtgtactattgcgccagaagcacttattacggaggggactggtacttcaacgtgtggggggcagggaccaccgtgaccgtgtccgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 5 - protein, 1001 aa, Artificial Sequence
  Synthetic Sequence
DRMALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 6 - DNA, 3016 bp, Artificial Sequence
  Synthetic Sequence
gcgatcgcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccttaccagtgaccgccttgctcctgccgctggccttgctgctccacgccgccaggccggatatccagatgacccagagccccagctccctgtccgcatccgtgggcgacagagtgacaattacctgtagaagcagccaaagcatcgtgcatagcgtcggcaacacttttctggagtggtatcaacagaagcccgggaaggcccccaaactgctgatctacaaggtgagcaacagattcagcggggtcccaagcagattctccggcagcggctccgggactgacttcaccctgaccattagcagcctgcagccagaggacttcgccacatactactgcttccaagggagccagttcccctacaccttcggccaaggcactaaggtggagatcaaaggggggggaggaagcggcggaggagggagcggaggcgggggatccgaagtgcaactggtcgaatccggaggggggctggtccagcctggagggtccctgagactgagctgcgccgcaagcggctacgagttctccaggtcctggatgaactgggtgaggcaggccccaggaaaagggctggaatgggtgggcaggatctaccctggcgacggcgataccaactactccggaaagttcaagggcaggttcactatcagcgccgacactagcaagaataccgcctacctgcagatgaatagcctgagggccgaggacaccgccgtgtattactgcgctagagacggcagcagctgggattggtacttcgacgtgtggggccagggcactctggtgactgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 7 - protein, 990 aa, Artificial Sequence
  Synthetic Sequence
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 8 - DNA, 2989 bp, Artificial Sequence
  Synthetic Sequence
gcgatcgcatggccttaccagtgaccgccttgctcctgccgctggccttgctgctccacgccgccaggccggacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccttaccagtgaccgccttgctcctgccgctggccttgctgctccacgccgccaggccggacgtgcagatcacccagagccccagctacctggccgccagccccggcgagaccatcaccatcaactgcagagccagcaagagcatcagcaaggacctggcctggtaccaggagaagcccggcaagaccaacaagctgctgatctacagcggcagcaccctgcagagcggcatccccagcagattcagcggcagcggcagcggcaccgacttcaccctgaccatcagcagcctggagcccgaggacttcgccatgtactactgccagcagcacaacaagtacccctacaccttcggcggcggcaccaagctggagatcaagggaggggggggatccgggggaggaggctccggcggaggcggaagccaggtgcagctgcagcagcccggcgccgagctggtgagacccggcgccagcgtgaagctgagctgcaaggccagcggctacaccttcaccagctactggatgaactgggtgaagcagagacccgaccagggcctggagtggatcggcagaatcgacccctacgacagcgagacccactacaaccagaagttcaaggacaaggccatcctgaccgtggacaagagcagcagcaccgcctacatgcagctgagcagcctgaccagcgaggacagcgccgtgtactactgcgccagaggcaactgggacgactactggggccagggcaccaccctgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 9 - protein, 1066 aa, Artificial Sequence
  Synthetic Sequence
MALPVTALLLPLALLLHAARPQIVLTQSPAIMSASPGEKVTITCSASSSISYMHWFQQKPGTSPKLWIYTTSNLASGVPARFSGSGSGTSYSLTISRMEAEDAATYYCHQRSTYPLTFGSGTKLELKGGGGSGGGGSGGGGSQVQLQQSGAELAKPGASVKMSCKASGYTFTSYRMHWVKQRPGQGLEWIGYINPSTGYTEYNQKFKDKATLTADKSSSTAYMQLSSLTFEDSAVYYCARGGGVFDYWGQGTTLTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 10 - DNA, 3217 bp, Artificial Sequence
  Synthetic Sequence
gcgatcgcatggccttaccagtgaccgccttgctcctgccgctggccttgctgctccacgccgccaggccgcagatcgtgctgacccagagccccgccatcatgagcgccagccccggcgagaaggtgaccatcacctgcagcgccagcagcagcatcagctacatgcactggttccagcagaagcccggcaccagccccaagctgtggatctacaccaccagcaacctggccagcggcgtgcccgccagattcagcggcagcggcagcggcaccagctacagcctgaccatcagcagaatggaggccgaggacgccgccacctactactgccaccagagaagcacctaccccctgaccttcggcagcggcaccaagctggagctgaagggaggggggggatccgggggaggaggctccggcggaggcggaagccaggtgcagctgcagcagagcggcgccgagctggccaagcccggcgccagcgtgaagatgagctgcaaggccagcggctacaccttcaccagctacagaatgcactgggtgaagcagagacccggccagggcctggagtggatcggctacatcaaccccagcaccggctacaccgagtacaaccagaagttcaaggacaaggccaccctgaccgccgacaagagcagcagcaccgcctacatgcagctgagcagcctgaccttcgaggacagcgccgtgtactactgcgccagaggcggcggcgtgttcgactactggggccagggcaccaccctgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagctactaacttcagcctgctgaagcaggctggagacgtggaggagaaccctggacctatggccttaccagtgaccgccttgctcctgccgctggccttgctgctccacgccgccaggccggacgtgcagatcacccagagccccagctacctggccgccagccccggcgagaccatcaccatcaactgcagagccagcaagagcatcagcaaggacctggcctggtaccaggagaagcccggcaagaccaacaagctgctgatctacagcggcagcaccctgcagagcggcatccccagcagattcagcggcagcggcagcggcaccgacttcaccctgaccatcagcagcctggagcccgaggacttcgccatgtactactgccagcagcacaacaagtacccctacaccttcggcggcggcaccaagctggagatcaagggaggggggggatccgggggaggaggctccggcggaggcggaagccaggtgcagctgcagcagcccggcgccgagctggtgagacccggcgccagcgtgaagctgagctgcaaggccagcggctacaccttcaccagctactggatgaactgggtgaagcagagacccgaccagggcctggagtggatcggcagaatcgacccctacgacagcgagacccactacaaccagaagttcaaggacaaggccatcctgaccgtggacaagagcagcagcaccgcctacatgcagctgagcagcctgaccagcgaggacagcgccgtgtactactgcgccagaggcaactgggacgactactggggccagggcaccaccctgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtacaagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 11 - protein, 985 aa, Artificial Sequence
  Synthetic Sequence
MALPVTALLLPLALLLHAARPQIVLTQSPAIMSASPGEKVTITCSASSSISYMHWFQQKPGTSPKLWIYTTSNLASGVPARFSGSGSGTSYSLTISRMEAEDAATYYCHQRSTYPLTFGSGTKLELKGGGGSGGGGSGGGGSQVQLQQSGAELAKPGASVKMSCKASGYTFTSYRMHWVKQRPGQGLEWIGYINPSTGYTEYNQKFKDKATLTADKSSSTAYMQLSSLTFEDSAVYYCARGGGVFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 12 - DNA, 2974 bp, Artificial Sequence
  Synthetic Sequence
gcgatcgcatggccttaccagtgaccgccttgctcctgccgctggccttgctgctccacgccgccaggccgcagatcgtgctgacccagagccccgccatcatgagcgccagccccggcgagaaggtgaccatcacctgcagcgccagcagcagcatcagctacatgcactggttccagcagaagcccggcaccagccccaagctgtggatctacaccaccagcaacctggccagcggcgtgcccgccagattcagcggcagcggcagcggcaccagctacagcctgaccatcagcagaatggaggccgaggacgccgccacctactactgccaccagagaagcacctaccccctgaccttcggcagcggcaccaagctggagctgaagggaggggggggatccgggggaggaggctccggcggaggcggaagccaggtgcagctgcagcagagcggcgccgagctggccaagcccggcgccagcgtgaagatgagctgcaaggccagcggctacaccttcaccagctacagaatgcactgggtgaagcagagacccggccagggcctggagtggatcggctacatcaaccccagcaccggctacaccgagtacaaccagaagttcaaggacaaggccaccctgaccgccgacaagagcagcagcaccgcctacatgcagctgagcagcctgaccttcgaggacagcgccgtgtactactgcgccagaggcggcggcgtgttcgactactggggccagggcaccaccctgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagctactaacttcagcctgctgaagcaggctggagacgtggaggagaaccctggacctatggccttaccagtgaccgccttgctcctgccgctggccttgctgctccacgccgccaggccggacgtgcagatcacccagagccccagctacctggccgccagccccggcgagaccatcaccatcaactgcagagccagcaagagcatcagcaaggacctggcctggtaccaggagaagcccggcaagaccaacaagctgctgatctacagcggcagcaccctgcagagcggcatccccagcagattcagcggcagcggcagcggcaccgacttcaccctgaccatcagcagcctggagcccgaggacttcgccatgtactactgccagcagcacaacaagtacccctacaccttcggcggcggcaccaagctggagatcaagggaggggggggatccgggggaggaggctccggcggaggcggaagccaggtgcagctgcagcagcccggcgccgagctggtgagacccggcgccagcgtgaagctgagctgcaaggccagcggctacaccttcaccagctactggatgaactgggtgaagcagagacccgaccagggcctggagtggatcggcagaatcgacccctacgacagcgagacccactacaaccagaagttcaaggacaaggccatcctgaccgtggacaagagcagcagcaccgcctacatgcagctgagcagcctgaccagcgaggacagcgccgtgtactactgcgccagaggcaactgggacgactactggggccagggcaccaccctgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 13 - protein, 546 aa, Artificial Sequence
  Synthetic Sequence
MALPVTALLLPLALLLHAARPSDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKKISGGGGSGGGGSGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 14 - DNA, 1657 bp, Artificial Sequence
  Synthetic Sequence
gcgatcgcatggccttaccagtgaccgccttgctcctgccgctggccttgctgctccacgccgccaggccgagcgacatcgtgctgacccagagccccgccagcctggccgtgagcctgggccagagagccaccatcagctgcagagccagcaagagcgtgagcaccagcggctacagctacctgcactggtaccagcagaagcccggccagccccccaagctgctgatctacctggccagcaacctggagagcggcgtgcccgccagattcagcggcagcggcagcggcaccgacttcaccctgaacatccaccccgtggaggaggaggacgccgccacctactactgccagcacagcagagagctgcccttcaccttcggcagcggcaccaagctggagatcaagaagatcagcggcggcggcggcagcggcggcggcggcagcggcggcggcggcagcggcggcggcggcagcggcggcggcggcagccaggtgcagctggtggagagcggcggcggcctggtgcagcccggcggcagcctgaagctgagctgcgccgccagcggcttcgacttcagcagatactggatgagctgggtgagacaggcccccggcaagggcctggagtggatcggcgagatcaaccccaccagcagcaccatcaacttcacccccagcctgaaggacaaggtgttcatcagcagagacaacgccaagaacaccctgtacctgcagatgagcaaggtgagaagcgaggacaccgccctgtactactgcgccagaggcaactactacagatacggcgacgccatggactactggggccagggcaccagcgtgaccgtgagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 15 - protein, 490 aa, Artificial Sequence
  Synthetic Sequence
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 16 - DNA, 1489 bp, Artificial Sequence
  Synthetic Sequence
gcgatcgcatggccttaccagtgaccgccttgctcctgccgctggccttgctgctccacgccgccaggccggacatcgtgctgacccagagccccgccagcctggccgtgagcctgggccagagggccaccatcagctgcagggccagcaagagcgtgagcaccagcggctacagctacctgcactggtaccagcagaagcccggccagccccccaagctgctgatctacctggccagcaacctggagagcggcgtgcccgccaggttcagcggcagcggcagcggcaccgacttcaccctgaacatccaccccgtggaggaggaggacgccgccacctactactgccagcacagcagggagctgcccttcaccttcggcagcggcaccaagctggagatcaagggaggggggggatccgggggaggaggctccggcggaggcggaagccaggtgcagctggtggagagcggcggcggcctggtgcagcccggcggcagcctgaagctgagctgcgccgccagcggcttcgacttcagcaggtactggatgagctgggtgaggcaggcccccggcaagggcctggagtggatcggcgagatcaaccccaccagcagcaccatcaacttcacccccagcctgaaggacaaggtgttcatcagcagggacaacgccaagaacaccctgtacctgcagatgagcaaggtgaggagcgaggacaccgccctgtactactgcgccaggggcaactactacaggtacggcgacgccatggactactggggccagggcaccagcgtgaccgtgagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 17 - protein, 491 aa, Artificial Sequence
  Synthetic Sequence
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 18 - DNA, 1492 bp, Artificial Sequence
  Synthetic Sequence
gcgatcgcatggccttaccagtgaccgccttgctcctgccgctggccttgctgctccacgccgccaggccggacatcgtgctgacccagagccccgccagcctggccgtgagcctgggccagagggccaccatcagctgcagggccagcaagagcgtgagcaccagcggctacagctacctgcactggtaccagcagaagcccggccagccccccaagctgctgatctacctggccagcaacctggagagcggcgtgcccgccaggttcagcggcagcggcagcggcaccgacttcaccctgaacatccaccccgtggaggaggaggacgccgccacctactactgccagcacagcagggagctgcccttcaccttcggcagcggcaccaagctggagatcaagggaggggggggatccgggggaggaggctccggcggaggcggaagccaggtgcagctggtggagagcggcggcggcctggtgcagcccggcggcagcctgaagctgagctgcgccgccagcggcttcgacttcagcaggtactggatgagctgggtgaggcaggcccccggcaagggcctggagtggatcggcgagatcaaccccaccagcagcaccatcaacttcacccccagcctgaaggacaaggtgttcatcagcagggacaacgccaagaacaccctgtacctgcagatgagcaaggtgaggagcgaggacaccgccctgtactactgcgccaggggcaactactacaggtacggcgacgccatggactactggggccagggcaccagcgtgaccgtgagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 19 - protein, 997 aa, Artificial Sequence
  Synthetic Sequence
MALPVTALLLPLALLLHAARPDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLEIKGGGGSGGGGSGGGGSQIQLVQSGPDLKKPGETVKLSCKASGYTFTNFGMNWVKQAPGKGFKWMAWINTTRYTGESYFADDFKGRFAFSVETSATTAYLQINNLKTEDTATYFCARGEIYYGYDGGFAYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 20 - DNA, 2994 bp, Artificial Sequence
  Synthetic Sequence
atggccttaccagtgaccgccttgctcctgccgctggccttgctgctccacgccgccaggccggatgtggtgatgacccagagccatcgctttatgagcaccagcgtgggcgatcgcgtgagcattacctgccgcgcgagccaggatgtgaacaccgcggtgagctggtatcagcagaaaccgggccagagcccgaaactgctgatttttagcgcgagctatcgctataccggcgtgccggatcgctttaccggcagcggcagcggcgcggattttaccctgaccattagcagcgtgcaggcggaagatctggcggtgtattattgccagcagcattatagcaccccgtggacctttggcggcggcaccaaactggaaattaaaggaggggggggatccgggggaggaggctccggcggaggcggaagccagattcagctggtgcagagcggcccggatctgaaaaaaccgggcgaaaccgtgaaactgagctgcaaagcgagcggctatacctttaccaactttggcatgaactgggtgaaacaggcgccgggcaaaggctttaaatggatggcgtggattaacaccacccgctataccggcgaaagctattttgcggatgattttaaaggccgctttgcgtttagcgtggaaaccagcgcgaccaccgcgtatctgcagattaacaacctgaaaaccgaagataccgcgacctatttttgcgcgcgcggcgaaatttattatggctatgatggcggctttgcgtattggggccagggcaccctggtgaccgtgagcgcgaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccgccttaccagtgaccgccttgctcctgccgctggccttgctgctccacgccgccaggccggatattcagatgacccagagcccgagcagcctgagcgcgagcgtgggcgatcgcgtgaccattacctgcaaagcgagccaggatgtgggcattgcggtggcgtggtatcagcagaaaccgggcaaagtgccgaaactgctgatttattgggcgagcacccgccataccggcgtgccggatcgctttagcggcagcggcagcggcaccgattttaccctgaccattagcagcctgcagccggaagatgtggcgacctattattgccagcagtatagcagctatccgtatacctttggccagggcaccaaagtggaaattaaaggaggggggggatccgggggaggaggctccggcggaggcggaagcgaagtgcagctggtggaaagcggcggcggcctggtgcagccgggcggcagcctgcgcctgagctgcgcggcgagcggctttgattttagccgctattggatgagctgggtgcgccaggcgccgggcaaaggcctggaatggattggcgaaattaacccggatagcagcaccattaactatgcgccgagcctgaaagataaatttattattagccgcgataacgcgaaaaacagcctgtatctgcagatgaacagcctgcgcgcggaagataccgcggtgtattattgcgcgcgcccggatggcaactattggtattttgatgtgtggggccagggcaccctggtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaa

SEQ ID NO: 21 - protein, 997 aa, Artificial Sequence
  Synthetic Sequence
MALPVTALLLPLALLLHAARPDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKGGGGSGGGGSGGGGSQIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 22 - DNA, 3009 bp, Artificial Sequence
  Synthetic Sequence
cgatcgcatggccttaccagtgaccgccttgctcctgccgctggccttgctgctccacgccgccaggccggatgtggtgatgacccagagccatcgctttatgagcaccagcgtgggagatcgagtgagcattacctgccgcgcgagccaggatgtgaacaccgcggtgagctggtatcagcagaaaccgggccagagcccgaaactgctgatttttagcgcgagctatcgctataccggcgtgccggatcgctttaccggcagcggcagcggcgcggattttaccctgaccattagcagcgtgcaggcggaagatctggcggtgtattattgccagcagcattatagcaccccgtggacctttggcggcggcaccaaactggatattaaaggaggggggggatccgggggaggaggctccggcggaggcggaagccagattcagctggtgcagagcggcccggatctgaaaaaaccgggcgaaaccgtgaaactgagctgcaaagcgagcggctatacctttaccaactttggcatgaactgggtgaaacaggcgccgggcaaaggctttaaatggatggcgtggattaacacctataccggcgaaagctattttgcggatgattttaaaggccgctttgcgtttagcgtggaaaccagcgcgaccaccgcgtatctgcagattaacaacctgaaaaccgaagataccgcgacctatttttgcgcgcgcggcgaaatttattatggctatgatggcggctttgcgtattggggccagggcaccctggtgaccgtgagcgcgaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaagcaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccttaccagtgaccgccttgctcctgccgctggccttgctgctccacgccgccaggccggatattcagatgacccagagcccgagcagcctgagcgcgagcgtgggcgaccgcgtgaccattacctgcaaagcgagccaggatgtgggcattgcggtggcgtggtatcagcagaaaccgggcaaagtgccgaaactgctgatttattgggcgagcacccgccataccggcgtgccggatcgctttagcggcagcggcagcggcaccgattttaccctgaccattagcagcctgcagccggaagatgtggcgacctattattgccagcagtatagcagctatccgtatacctttggccagggcaccaaagtggaaattaaaggaggggggggatccgggggaggaggctccggcggaggcggaagcgaagtgcagctggtggaaagcggcggcggcctggtgcagccgggcggcagcctgcgcctgagctgcgcggcgagcggctttgattttagccgctattggatgagctgggtgcgccaggcgccgggcaaaggcctggaatggattggcgaaattaacccggatagcagcaccattaactatgcgccgagcctgaaagataaatttattattagccgcgataacgcgaaaaacagcctgtatctgcagatgaacagcctgcgcgcggaagataccgcggtgtattattgcgcgcgcccggatggcaactattggtattttgatgtgtggggccagggcaccctggtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaagcaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 23 - DNA, 423 bp, Artificial Sequence
  Synthetic Sequence
agctagctgcagtaacgccattttgcaaggcatggaaaaataccaaaccaagaatagagaagttcagatcaagggcgggtacatgaaaatagctaacgttgggccaaacaggatatctgcggtgagcagtttcggccccggcccggggccaagaacagatggtcaccgcagtttcggccccggcccgaggccaagaacagatggtccccagatatggcccaaccctcagcagtttcttaagacccatcagatgtttccaggctcccccaaggacctgaaatgaccctgcgccttatttgaattaaccaatcagcctgcttctcgcttctgttcgcgcgcttctgcttcccgagctctataaaagagctcacaacccctcactcggcgcgccagtcctccgacagactgagtcgcccgggtacc

SEQ ID NO: 24 - protein, 165 aa, Artificial Sequence
  Synthetic Sequence
MSGLGRSRRGGRSRVDQEERFPQGLWTGVAMRSCPEEQYWDPLLGTCMSCKTICNHQSQRTCAAFCRSLSCRKEQGKFYDHLLRDCISCASICGQHPKQCAYFCENKLRSPVNLPPELRRQRSGEVENNSDNSGRYQGLEHRGSEASPALPGLKLSADQVALVYS

SEQ ID NO: 25 - protein, 54 aa, Artificial Sequence
  Synthetic Sequence
MLQMAGQCSQNEYFDSLLHACIPCQLRCSSNTPPLTCQRYCNASVTNSVKGTNA

SEQ ID NO: 26 - protein, 204 aa, Artificial Sequence
  Synthetic Sequence
SGPVKELVGSVGGAVTFPLKSKVKQVDSIVWTFNTTPLVTIQPEGGTIIVTQNRNRERVDFPDGGYSLKLSKLKKNDSGIYYVGIYSSSLQQPSTQEYVLHVYEHLSKPKVTMGLQSNKNGTCVTNLTCCMEHGEEDVIYTWKALGQAANESHNGSILPISWRWGESDMTFICVARNPVSRNFSSPILARKLCEGAADDPDSSM

SEQ ID NO: 27 - protein, 46 aa, Artificial Sequence
  Synthetic Sequence
MDDSTEREQSRLTSCLKKREEMKLKECVSILPRKESPSVRSSKDGK

SEQ ID NO: 28 - protein, 242 aa, Artificial Sequence
  Synthetic Sequence
DPNFWLQVQESVTVQEGLCVLVPCTFFHPIPYYDKNSPVHGYWFREGAIISRDSPVATNKLDQEVQEETQGRFRLLGDPSRNNCSLSIVDARRRDNGSYFFRMERGSTKYSYKSPQLSVHVTDLTHRPKILIPGTLEPGHSKNLTCSVSWACEQGTPPIFSWLSAAPTSLGPRTTHSSVLIITPRPQDHGTNLTCQVKFAGAGVTTERTIQLNVTYVPQNPTTGIFPGDGSGKQETRAGVVH

SEQ ID NO: 29 - protein, 287 aa, Artificial Sequence
  Synthetic Sequence
TKEDPNPPITNLRMKAKAQQLTWDLNRNVTDIECVKDADYSMPAVNNSYCQFGAISLCEVTNYTVRVANPPFSTWILFPENSGKPWAGAENLTCWIHDVDFLSCSWAVGPGAPADVQYDLYLNVANRRQQYECLHYKTDAQGTRIGCRFDDISRLSSGSQSSHILVRGRSAAFGIPCTDKFVVFSQIEILTPPNMTAKCNKTHSFMHWKMRSHFNRKFRYELQIQKRMQPVITEQVRDRTSFQLLNPGTYTVQIRARERVYEFLSAWSTPQRFECDQEEGANTRAWR

SEQ ID NO: 30 - protein, 272 aa, Artificial Sequence
  Synthetic Sequence
PEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWK

SEQ ID NO: 31 - protein, 6 aa, Artificial Sequence
  Synthetic Sequence
PICVTV

SEQ ID NO: 32 - protein, 47 aa, Artificial Sequence
  Synthetic Sequence
KISHFLKMESLNFIRAHTPYINIYNCEPANPSEKNSPSTQYCYSIQS

SEQ ID NO: 33 - protein, 480 aa, Artificial Sequence
  Synthetic Sequence
DSSKWVFEHPETLYAWEGACVWIPCTYRALDGDLESFILFHNPEYNKNTSKFDGTRLYESTKDGKVPSEQKRVQFLGDKNKNCTLSIHPVHLNDSGQLGLRMESKTEKWMERIHLNVSERPFPPHIQLPPEIQESQEVTLTCLLNFSCYGYPIQLQWLLEGVPMRQAAVTSTSLTIKSVFTRSELKFSPQWSHHGKIVTCQLQDADGKFLSNDTVQLNVKHTPKLEIKVTPSDAIVREGDSVTMTCEVSSSNPEYTTVSWLKDGTSLKKQNTFTLNLREVTKDQSGKYCCQVSNDVGPGRSEEVFLQVQYAPEPSTVQILHSPAVEGSQVEFLCMSLANPLPTNYTWYHNGKEMQGRTEEKVHIPKILPWHAGTYSCVAENILGTGQRGPGAELDVQYPPKKVTTVIQNPMPIREGDTVTLSCNYNSSNPSVTRYEWKPHGAWEEPSLGVLKIQNVGWDNTTIACAACNSWCSWASPVAL

SEQ ID NO: 34 - protein, 480 aa, Artificial Sequence
  Synthetic Sequence
QSPTPSPTGLTTAKMPSVPLSSDPLPTHTTAFSPASTFERENDFSETTTSLSPDNTSTQVSPDSLDNASAFNTTGVSSVQTPHLPTHADSQTPSAGTDTQTFSGSAANAKLNPTPGSNAISDVPGERSTASTFPTDPVSPLTTTLSLAHHSSAALPARTSNTTITANTSDAYLNASETTTLSPSGSAVISTTTIATTPSKPTCDEKYANITVDYLYNKETKLFTAKLNVNENVECGNNTCTNNEVHNLTECKNASVSISHNSCTAPDKTLILDVPPGVEKFQLHDCTQVEKADTTICLKWKNIETFTCDTQNITYRFQCGNMIFDNKEIKLENLEPEHEYKCDSEILYNNHKFTNASKIIKTDFGSPGEPQIIFCRSEAAHQGVITWNPPQRSFHNFTLCYIKETEKDCLNLDKNLIKYDLQNLKPYTKYVLSLHAYIIAKVQRNGSAAMCHFTTKSAPPSQVWNMTVSMTSDNSMHVKC

SEQ ID NO: 35 - protein, 371 aa, Artificial Sequence
  Synthetic Sequence
KKVVLGKKGDTVELTCTASQKKSIQFHWKNSNQIKILGNQGSFLTKGPSKLNDRADSRRSLWDQGNFPLIIKNLKIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKASSIVYKKEGEQVEFSFPLAFTVEKLTGSGELWWQAERASSSKSWITFDLKNKEVSVKRVTQDPKLQMGKKLPLHLTLPQALPQYAGSGNLTLALEAKTGKLHQEVNLVVMRATQLQKNLTCEVWGPTSPKLMLSLKLENKEAKVSKREKAVWVLNPEAGMWQCLLSDSGQVLLESNIKVLPTWSTPVQP

SEQ ID NO: 36 - protein, 219 aa, Artificial Sequence
  Synthetic Sequence
ELCDDDPPEIPHATFKAMAYKEGTMLNCECKRGFRRIKSGSLYMLCTGNSSHSSWDNQCQCTSSATRNTTKQVTPQPEEQKERKTTEMQSPMQPVDQASLPGHCREPPPWENEATERIYHFVVGQMVYYQCVQGYRALHRGPAESVCKMTHGKTRWTQPQLICTGEMETSQFPGEEKPQASPEGRPESETSCLVTTTDFQIQTEMAATMETSIFTTEYQ

SEQ ID NO: 37 - DNA, 3799 bp, Artificial Sequence
  Synthetic Sequence
gcgatcgcatggccttaccagtgaccgccttgctcctgccgctggccttgctgctccacgccgccaggccgcagatcgtgctgacccagagccccgccatcatgagcgccagccccggcgagaaggtgaccatcacctgcagcgccagcagcagcatcagctacatgcactggttccagcagaagcccggcaccagccccaagctgtggatctacaccaccagcaacctggccagcggcgtgcccgccagattcagcggcagcggcagcggcaccagctacagcctgaccatcagcagaatggaggccgaggacgccgccacctactactgccaccagagaagcacctaccccctgaccttcggcagcggcaccaagctggagctgaagggaggggggggatccgggggaggaggctccggcggaggcggaagccaggtgcagctgcagcagagcggcgccgagctggccaagcccggcgccagcgtgaagatgagctgcaaggccagcggctacaccttcaccagctacagaatgcactgggtgaagcagagacccggccagggcctggagtggatcggctacatcaaccccagcaccggctacaccgagtacaaccagaagttcaaggacaaggccaccctgaccgccgacaagagcagcagcaccgcctacatgcagctgagcagcctgaccttcgaggacagcgccgtgtactactgcgccagaggcggcggcgtgttcgactactggggccagggcaccaccctgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagctactaacttcagcctgctgaagcaggctggagacgtggaggagaaccctggacctatggccttaccagtgaccgccttgctcctgccgctggccttgctgctccacgccgccaggccggacgtgcagatcacccagagccccagctacctggccgccagccccggcgagaccatcaccatcaactgcagagccagcaagagcatcagcaaggacctggcctggtaccaggagaagcccggcaagaccaacaagctgctgatctacagcggcagcaccctgcagagcggcatccccagcagattcagcggcagcggcagcggcaccgacttcaccctgaccatcagcagcctggagcccgaggacttcgccatgtactactgccagcagcacaacaagtacccctacaccttcggcggcggcaccaagctggagatcaagggaggggggggatccgggggaggaggctccggcggaggcggaagccaggtgcagctgcagcagcccggcgccgagctggtgagacccggcgccagcgtgaagctgagctgcaaggccagcggctacaccttcaccagctactggatgaactgggtgaagcagagacccgaccagggcctggagtggatcggcagaatcgacccctacgacagcgagacccactacaaccagaagttcaaggacaaggccatcctgaccgtggacaagagcagcagcaccgcctacatgcagctgagcagcctgaccagcgaggacagcgccgtgtactactgcgccagaggcaactgggacgactactggggccagggcaccaccctgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataagtttaaac

SEQ ID NO: 38 - protein, 1260 aa, Artificial Sequence
  Synthetic Sequence
MALPVTALLLPLALLLHAARPQIVLTQSPAIMSASPGEKVTITCSASSSISYMHWFQQKPGTSPKLWIYTTSNLASGVPARFSGSGSGTSYSLTISRMEAEDAATYYCHQRSTYPLTFGSGTKLELKGGGGSGGGGSGGGGSQVQLQQSGAELAKPGASVKMSCKASGYTFTSYRMHWVKQRPGQGLEWIGYINPSTGYTEYNQKFKDKATLTADKSSSTAYMQLSSLTFEDSAVYYCARGGGVFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 39 - DNA, 3856 bp, Artificial Sequence
  Synthetic Sequence
gcgatcgcatggccttaccagtgaccgccttgctcctgccgctggccttgctgctccacgccgccaggccgcagatcgtgctgacccagagccccgccatcatgagcgccagccccggcgagaaggtgaccatcacctgcagcgccagcagcagcatcagctacatgcactggttccagcagaagcccggcaccagccccaagctgtggatctacaccaccagcaacctggccagcggcgtgcccgccagattcagcggcagcggcagcggcaccagctacagcctgaccatcagcagaatggaggccgaggacgccgccacctactactgccaccagagaagcacctaccccctgaccttcggcagcggcaccaagctggagctgaagggaggggggggatccgggggaggaggctccggcggaggcggaagccaggtgcagctgcagcagagcggcgccgagctggccaagcccggcgccagcgtgaagatgagctgcaaggccagcggctacaccttcaccagctacagaatgcactgggtgaagcagagacccggccagggcctggagtggatcggctacatcaaccccagcaccggctacaccgagtacaaccagaagttcaaggacaaggccaccctgaccgccgacaagagcagcagcaccgcctacatgcagctgagcagcctgaccttcgaggacagcgccgtgtactactgcgccagaggcggcggcgtgttcgactactggggccagggcaccaccctgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagctactaacttcagcctgctgaagcaggctggagacgtggaggagaaccctggacctatggccttaccagtgaccgccttgctcctgccgctggccttgctgctccacgccgccaggccggacgtgcagatcacccagagccccagctacctggccgccagccccggcgagaccatcaccatcaactgcagagccagcaagagcatcagcaaggacctggcctggtaccaggagaagcccggcaagaccaacaagctgctgatctacagcggcagcaccctgcagagcggcatccccagcagattcagcggcagcggcagcggcaccgacttcaccctgaccatcagcagcctggagcccgaggacttcgccatgtactactgccagcagcacaacaagtacccctacaccttcggcggcggcaccaagctggagatcaagggaggggggggatccgggggaggaggctccggcggaggcggaagccaggtgcagctgcagcagcccggcgccgagctggtgagacccggcgccagcgtgaagctgagctgcaaggccagcggctacaccttcaccagctactggatgaactgggtgaagcagagacccgaccagggcctggagtggatcggcagaatcgacccctacgacagcgagacccactacaaccagaagttcaaggacaaggccatcctgaccgtggacaagagcagcagcaccgcctacatgcagctgagcagcctgaccagcgaggacagcgccgtgtactactgcgccagaggcaactgggacgactactggggccagggcaccaccctgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 40 - protein, 1279 aa, Artificial Sequence
  Synthetic Sequence
MALPVTALLLPLALLLHAARPQIVLTQSPAIMSASPGEKVTITCSASSSISYMHWFQQKPGTSPKLWIYTTSNLASGVPARFSGSGSGTSYSLTISRMEAEDAATYYCHQRSTYPLTFGSGTKLELKGGGGSGGGGSGGGGSQVQLQQSGAELAKPGASVKMSCKASGYTFTSYRMHWVKQRPGQGLEWIGYINPSTGYTEYNQKFKDKATLTADKSSSTAYMQLSSLTFEDSAVYYCARGGGVFDYWGQGTTLTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 41 - DNA, 2314 bp, Artificial Sequence
  Synthetic Sequence
gcgatcgcatggccttaccagtgaccgccttgctcctgccgctggccttgctgctccacgccgccaggccggacatcgtgctgacccagagccccgccagcctggccgtgagcctgggccagagggccaccatcagctgcagggccagcaagagcgtgagcaccagcggctacagctacctgcactggtaccagcagaagcccggccagccccccaagctgctgatctacctggccagcaacctggagagcggcgtgcccgccaggttcagcggcagcggcagcggcaccgacttcaccctgaacatccaccccgtggaggaggaggacgccgccacctactactgccagcacagcagggagctgcccttcaccttcggcagcggcaccaagctggagatcaagggaggggggggatccgggggaggaggctccggcggaggcggaagccaggtgcagctggtggagagcggcggcggcctggtgcagcccggcggcagcctgaagctgagctgcgccgccagcggcttcgacttcagcaggtactggatgagctgggtgaggcaggcccccggcaagggcctggagtggatcggcgagatcaaccccaccagcagcaccatcaacttcacccccagcctgaaggacaaggtgttcatcagcagggacaacgccaagaacaccctgtacctgcagatgagcaaggtgaggagcgaggacaccgccctgtactactgcgccaggggcaactactacaggtacggcgacgccatggactactggggccagggcaccagcgtgaccgtgagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataagtttaaac

SEQ ID NO: 42 - protein, 765 aa, Artificial Sequence
  Synthetic Sequence
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 43 - DNA, 2371 bp, Artificial Sequence
  Synthetic Sequence
gcgatcgcatggccttaccagtgaccgccttgctcctgccgctggccttgctgctccacgccgccaggccggacatcgtgctgacccagagccccgccagcctggccgtgagcctgggccagagggccaccatcagctgcagggccagcaagagcgtgagcaccagcggctacagctacctgcactggtaccagcagaagcccggccagccccccaagctgctgatctacctggccagcaacctggagagcggcgtgcccgccaggttcagcggcagcggcagcggcaccgacttcaccctgaacatccaccccgtggaggaggaggacgccgccacctactactgccagcacagcagggagctgcccttcaccttcggcagcggcaccaagctggagatcaagggaggggggggatccgggggaggaggctccggcggaggcggaagccaggtgcagctggtggagagcggcggcggcctggtgcagcccggcggcagcctgaagctgagctgcgccgccagcggcttcgacttcagcaggtactggatgagctgggtgaggcaggcccccggcaagggcctggagtggatcggcgagatcaaccccaccagcagcaccatcaacttcacccccagcctgaaggacaaggtgttcatcagcagggacaacgccaagaacaccctgtacctgcagatgagcaaggtgaggagcgaggacaccgccctgtactactgcgccaggggcaactactacaggtacggcgacgccatggactactggggccagggcaccagcgtgaccgtgagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 44 - protein, 784 aa, Artificial Sequence
  Synthetic Sequence
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 45 - DNA, 2369 bp, Artificial Sequence
  Synthetic Sequence
atggccttaccagtgaccgccttgctcctgccgctggccttgctgctccacgccgccaggccggatgtggtgatgacccagagccatcgctttatgagcaccagcgtgggcgaccgagtgagcattacctgccgcgcgagccaggatgtgaacaccgcggtgagctggtatcagcagaaaccgggccagagcccgaaactgctgatttttagcgcgagctatcgctataccggcgtgccggatcgctttaccggcagcggcagcggcgcggattttaccctgaccattagcagcgtgcaggcggaagatctggcggtgtattattgccagcagcattatagcaccccgtggacctttggcggcggcaccaaactggacattaaaggaggggggggatccgggggaggaggctccggcggaggcggaagccagattcagctggtgcagagcggcccggatctgaaaaaaccgggcgaaaccgtgaaactgagctgcaaagcgagcggctatacctttaccaactttggcatgaactgggtgaaacaggcgccgggcaaaggctttaaatggatggcgtggattaacaccacccgctataccggcgaaagctattttgcggatgattttaaaggccgctttgcgtttagcgtggaaaccagcgcgaccaccgcgtatctgcagattaacaacctgaaaaccgaagataccgcgacctatttttgcgcgcgcggcgaaatttattatggctatgatggcggctttgcgtattggggccagggcaccctggtgaccgtgagcgcgaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 46 - protein, 786 aa, Artificial Sequence
  Synthetic Sequence
MALPVTALLLPLALLLHAARPDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKGGGGSGGGGSGGGGSQIQLVQSGPDLKKPGETVKLSCKASGYTFTNFGMNWVKQAPGKGFKWMAWINTTRYTGESYFADDFKGRFAFSVETSATTAYLQINNLKTEDTATYFCARGEIYYGYDGGFAYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 47 - DNA, 3019 bp, Artificial Sequence
  Synthetic Sequence
gcgatcgcaccatggccttaccagtgaccgccttgctcctgccgctggccttgctgctccacgccgccaggccggatgtggtgatgacccagagccatcgctttatgagcaccagcgtgggcgaccgagtgagcattacctgccgcgcgagccaggatgtgaacaccgcggtgagctggtatcagcagaaaccgggccagagcccgaaactgctgatttttagcgcgagctatcgctataccggcgtgccggatcgctttaccggcagcggcagcggcgcggattttaccctgaccattagcagcgtgcaggcggaagatctggcggtgtattattgccagcagcattatagcaccccgtggacctttggcggcggcaccaaactggacattaaaggaggggggggatccgggggaggaggctccggcggaggcggaagccagattcagctggtgcagagcggcccggatctgaaaaaaccgggcgaaaccgtgaaactgagctgcaaagcgagcggctatacctttaccaactttggcatgaactgggtgaaacaggcgccgggcaaaggctttaaatggatggcgtggattaacaccacccgctataccggcgaaagctattttgcggatgattttaaaggccgctttgcgtttagcgtggaaaccagcgcgaccaccgcgtatctgcagattaacaacctgaaaaccgaagataccgcgacctatttttgcgcgcgcggcgaaatttattatggctatgatggcggctttgcgtattggggccagggcaccctggtgaccgtgagcgcgaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccctgcccgtgaccgccctgctgctgcccctggccctgctgctgcacgccgccaggcccgatattcagatgacccagagcccgagcagcctgagcgcgagcgtgggcgaccgggtgaccattacctgcaaagcgagccaggatgtgggcattgcggtggcgtggtatcagcagaaaccgggcaaagtgccgaaactgctgatttattgggcgagcacccgccataccggcgtgccggatcgctttagcggcagcggcagcggcaccgattttaccctgaccattagcagcctgcagccggaagatgtggcgacctattattgccagcagtatagcagctatccgtatacctttggccagggcaccaaagtggaaattaaaggaggggggggatccgggggaggaggctccggcggaggcggaagcgaagtgcagctggtggaaagcggcggcggcctggtgcagccgggcggcagcctgcgcctgagctgcgcggcgagcggctttgattttagccgctattggatgagctgggtgcgccaggcgccgggcaaaggcctggaatggattggcgaaattaacccggatagcagcaccattaactatgcgccgagcctgaaagataaatttattattagccgcgataacgcgaaaaacagcctgtatctgcagatgaacagcctgcgcgcggaagataccgcggtgtattattgcgcgcgcccggatggcaactattggtattttgatgtgtggggccagggcaccctggtgaccgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaagaggggcaggaagaagctgctgtacatcttcaagcagcccttcatgaggcccgtgcagaccacccaggaggaggacggctgcagctgcaggttccccgaggaggaggagggcggctgcgagctgagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 48 - protein, 999 aa, Artificial Sequence
  Synthetic Sequence
MALPVTALLLPLALLLHAARPDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKGGGGSGGGGSGGGGSQIQLVQSGPDLKKPGETVKLSCKASGYTFTNFGMNWVKQAPGKGFKWMAWINTTRYTGESYFADDFKGRFAFSVETSATTAYLQINNLKTEDTATYFCARGEIYYGYDGGFAYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 49 - DNA, 3040 bp, Artificial Sequence
  Synthetic Sequence
gcgatcgcaccatggccttaccagtgaccgccttgctcctgccgctggccttgctgctccacgccgccaggccggatgtggtgatgacccagagccatcgctttatgagcaccagcgtgggcgaccgagtgagcattacctgccgcgcgagccaggatgtgaacaccgcggtgagctggtatcagcagaaaccgggccagagcccgaaactgctgatttttagcgcgagctatcgctataccggcgtgccggatcgctttaccggcagcggcagcggcgcggattttaccctgaccattagcagcgtgcaggcggaagatctggcggtgtattattgccagcagcattatagcaccccgtggacctttggcggcggcaccaaactggacattaaaggaggggggggatccgggggaggaggctccggcggaggcggaagccagattcagctggtgcagagcggcccggatctgaaaaaaccgggcgaaaccgtgaaactgagctgcaaagcgagcggctatacctttaccaactttggcatgaactgggtgaaacaggcgccgggcaaaggctttaaatggatggcgtggattaacaccacccgctataccggcgaaagctattttgcggatgattttaaaggccgctttgcgtttagcgtggaaaccagcgcgaccaccgcgtatctgcagattaacaacctgaaaaccgaagataccgcgacctatttttgcgcgcgcggcgaaatttattatggctatgatggcggctttgcgtattggggccagggcaccctggtgaccgtgagcgcgaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccctgcccgtgaccgccctgctgctgcccctggccctgctgctgcacgccgccaggcccgaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaggagtaagaggagcaggctcctgcacagtgactacatgaacatgactccccgccgccccgggcccacccgcaagcattaccagccctatgccccaccacgcgacttcgcagcctatcgctccagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 50 - protein, 1006 aa, Artificial Sequence
  Synthetic Sequence
MALPVTALLLPLALLLHAARPDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKGGGGSGGGGSGGGGSQIQLVQSGPDLKKPGETVKLSCKASGYTFTNFGMNWVKQAPGKGFKWMAWINTTRYTGESYFADDFKGRFAFSVETSATTAYLQINNLKTEDTATYFCARGEIYYGYDGGFAYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 51 - DNA, 3022 bp, Artificial Sequence
  Synthetic Sequence
gcgatcgcaccatggccttaccagtgaccgccttgctcctgccgctggccttgctgctccacgccgccaggccggatgtggtgatgacccagagccatcgctttatgagcaccagcgtgggcgaccgagtgagcattacctgccgcgcgagccaggatgtgaacaccgcggtgagctggtatcagcagaaaccgggccagagcccgaaactgctgatttttagcgcgagctatcgctataccggcgtgccggatcgctttaccggcagcggcagcggcgcggattttaccctgaccattagcagcgtgcaggcggaagatctggcggtgtattattgccagcagcattatagcaccccgtggacctttggcggcggcaccaaactggacattaaaggaggggggggatccgggggaggaggctccggcggaggcggaagccagattcagctggtgcagagcggcccggatctgaaaaaaccgggcgaaaccgtgaaactgagctgcaaagcgagcggctatacctttaccaactttggcatgaactgggtgaaacaggcgccgggcaaaggctttaaatggatggcgtggattaacaccacccgctataccggcgaaagctattttgcggatgattttaaaggccgctttgcgtttagcgtggaaaccagcgcgaccaccgcgtatctgcagattaacaacctgaaaaccgaagataccgcgacctatttttgcgcgcgcggcgaaatttattatggctatgatggcggctttgcgtattggggccagggcaccctggtgaccgtgagcgcgaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccctgcccgtgaccgccctgctgctgcccctggccctgctgctgcacgccgccaggcccgacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaagaggggcaggaagaagctgctgtacatcttcaagcagcccttcatgaggcccgtgcagaccacccaggaggaggacggctgcagctgcaggttccccgaggaggaggagggcggctgcgagctgagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 52 - protein, 1000 aa, Artificial Sequence
  Synthetic Sequence
MALPVTALLLPLALLLHAARPDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKGGGGSGGGGSGGGGSQIQLVQSGPDLKKPGETVKLSCKASGYTFTNFGMNWVKQAPGKGFKWMAWINTTRYTGESYFADDFKGRFAFSVETSATTAYLQINNLKTEDTATYFCARGEIYYGYDGGFAYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 53 - DNA, 1483 bp, Artificial Sequence
  Synthetic Sequence
gcgatcgcaccatggccctgcccgtgaccgccctgctgctgcccctggccctgctgctgcacgccgccaggcccgacatccagatgacacagactacatcctccctgtctgcctctctgggagacagagtcaccatcagttgcagggcaagtcaggacattagtaaatatttaaattggtatcagcagaaaccagatggaactgttaaactcctgatctaccatacatcaagattacactcaggagtcccatcaaggttcagtggcagtgggtctggaacagattattctctcaccattagcaacctggagcaagaagatattgccacttacttttgccaacagggtaatacgcttccgtacacgttcggaggggggaccaagctggagatcacaggtggcggtggctcgggcggtggtgggtcgggtggcggcggatctgaggtgaaactgcaggagtcaggacctggcctggtggcgccctcacagagcctgtccgtcacatgcactgtctcaggggtctcattacccgactatggtgtaagctggattcgccagcctccacgaaagggtctggagtggctgggagtaatatggggtagtgaaaccacatactataattcagctctcaaatccagactgaccatcatcaaggacaactccaagagccaagttttcttaaaaatgaacagtctgcaaactgatgacacagccatttactactgtgccaaacattattactacggtggtagctatgctatggactactggggccaaggaacctcagtcaccgtctcctcaaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 54 - protein, 487 aa, Artificial Sequence
  Synthetic Sequence
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 55 - DNA, 1501 bp, Artificial Sequence
  Synthetic Sequence
gcgatcgcatggccttaccagtgaccgccttgctcctgccgctggccttgctgctccacgccgccaggccggaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 56 - protein, 494 aa, Artificial Sequence [sequence omitted]

SEQ ID NO: 57 - DNA, 2293 bp, Artificial Sequence
  Synthetic Sequence
gcgatcgcaccatggccctgcccgtgaccgccctgctgctgcccctggccctgctgctgcacgccgccaggcccgacattcagctgacccagtctccagcaatcctttctgcatctccaggggagaaggtcacaatgacttgcagggccagctcaagtttaagtttcatgcactggtaccagcagaagccaggatcctcccccaaaccctggatttatgccacatccaacctggcttctggagtccctgctcgcttcagtggcagtgggtctgggacctcttactctctcacaatcagcacagtggaggctgaagatgctgcctcttatttctgccatcagtggagtagtaacccgctcacgttcggtgctgggaccaagctggagatcagctcgggcggcggcggctcgggcggcggcggctccggagacgtcatgggggtggattctgggggaggcttagtgcagcctggagggtcccggaaactctcctgtgcagcccctggattcactttcagtagctttgggatgcactgggttcgtcaggctccagagaaggggttggagtgggtcgcatacattagtagtcccagtagtaccctccactatgcagacagagtgaagggccgattcaccatctccagagacaatcccaagaacaccctgttcctgcaaatgaaactaccctcactatgctatggactactggggccaagggaccacgttcacaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaggagtaagaggagcaggctcctgcacagtgactacatgaacatgactccccgccgccccgggcccacccgcaagcattaccagccctatgccccaccacgcgacttcgcagcctatcgctccagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 58 - protein, 757 aa, Artificial Sequence
  Synthetic Sequence
MALPVTALLLPLALLLHAARPDIQLTQSPAILSASPGEKVTMTCRASSSLSFMHWYQQKPGSSPKPWIYATSNLASGVPARFSGSGSGTSYSLTISTVEAEDAASYFCHQWSSNPLTFGAGTKLEISSGGGGSGGGGSGDVMGVDSGGGLVQPGGSRKLSCAAPGFTFSSFGMHWVRQAPEKGLEWVAYISSPSSTLHYADRVKGRFTISRDNPKNTLFLQMKLPSLCYGLLGPRDHVHTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 59 - DNA, 2389 bp, Artificial Sequence
  Synthetic Sequence
gcgatcgcaccatggccttaccagtgaccgccttgctcctgccgctggccttgctgctccacgccgccaggccggaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 60 - protein, 789 aa, Artificial Sequence
  Synthetic Sequence
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 61 - DNA, 2389 bp, Artificial Sequence
  Synthetic Sequence
gcgatcgcaccatggccctgcccgtgaccgccctgctgctgcccctggccctgctgctgcacgccgccaggcccgatatccagatgacccagagccccagctccctgtccgcatccgtgggcgacagagtgacaattacctgtagaagcagccaaagcatcgtgcatagcgtcggcaacacttttctggagtggtatcaacagaagcccgggaaggcccccaaactgctgatctacaaggtgagcaacagattcagcggggtcccaagcagattctccggcagcggctccgggactgacttcaccctgaccattagcagcctgcagccagaggacttcgccacatactactgcttccaagggagccagttcccctacaccttcggccaaggcactaaggtggagatcaaaggggggggaggaagcggcggaggagggagcggaggcgggggatccgaagtgcaactggtcgaatccggaggggggctggtccagcctggagggtccctgagactgagctgcgccgcaagcggctacgagttctccaggtcctggatgaactgggtgaggcaggccccaggaaaagggctggaatgggtgggcaggatctaccctggcgacggcgataccaactactccggaaagttcaagggcaggttcactatcagcgccgacactagcaagaataccgcctacctgcagatgaatagcctgagggccgaggacaccgccgtgtattactgcgctagagacggcagcagctgggattggtacttcgacgtgtggggccagggcactctggtgactgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 62 - protein, 789 aa, Artificial Sequence
  Synthetic Sequence
MALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 63 - DNA, 3049 bp, Artificial Sequence
  Synthetic Sequence
gcgatcgcatggccttaccagtgaccgccttgctcctgccgctggccttgctgctccacgccgccaggccggaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccctgcccgtgaccgccctgctgctgcccctggccctgctgctgcacgccgccaggcccgatatccagatgacccagagccccagctccctgtccgcatccgtgggcgacagagtgacaattacctgtagaagcagccaaagcatcgtgcatagcgtcggcaacacttttctggagtggtatcaacagaagcccgggaaggcccccaaactgctgatctacaaggtgagcaacagattcagcggggtcccaagcagattctccggcagcggctccgggactgacttcaccctgaccattagcagcctgcagccagaggacttcgccacatactactgcttccaagggagccagttcccctacaccttcggccaaggcactaaggtggagatcaaaggggggggaggaagcggcggaggagggagcggaggcgggggatccgaagtgcaactggtcgaatccggaggggggctggtccagcctggagggtccctgagactgagctgcgccgcaagcggctacgagttctccaggtcctggatgaactgggtgaggcaggccccaggaaaagggctggaatgggtgggcaggatctaccctggcgacggcgataccaactactccggaaagttcaagggcaggttcactatcagcgccgacactagcaagaataccgcctacctgcagatgaatagcctgagggccgaggacaccgccgtgtattactgcgctagagacggcagcagctgggattggtacttcgacgtgtggggccagggcactctggtgactgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctccagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 64 - protein, 1010 aa, Artificial Sequence
  Synthetic Sequence
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKGGGGSGGGGSGGGGSEVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 65 - DNA, 2953 bp, Artificial Sequence
  Synthetic Sequence
gcgatcgcatggccttaccagtgaccgccttgctcctgccgctggccttgctgctccacgccgccaggccggaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccctgcccgtgaccgccctgctgctgcccctggccctgctgctgcacgccgccaggcccgacattcagctgacccagtctccagcaatcctttctgcatctccaggggagaaggtcacaatgacttgcagggccagctcaagtttaagtttcatgcactggtaccagcagaagccaggatcctcccccaaaccctggatttatgccacatccaacctggcttctggagtccctgctcgcttcagtggcagtgggtctgggacctcttactctctcacaatcagcacagtggaggctgaagatgctgcctcttatttctgccatcagtggagtagtaacccgctcacgttcggtgctgggaccaagctggagatcagctcgggcggcggcggctcgggcggcggcggctccggagacgtcatgggggtggattctgggggaggcttagtgcagcctggagggtcccggaaactctcctgtgcagcccctggattcactttcagtagctttgggatgcactgggttcgtcaggctccagagaaggggttggagtgggtcgcatacattagtagtcccagtagtaccctccactatgcagacagagtgaagggccgattcaccatctccagagacaatcccaagaacaccctgttcctgcaaatgaaactaccctcactatgctatggactactggggccaagggaccacgttcacaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaggagtaagaggagcaggctcctgcacagtgactacatgaacatgactccccgccgccccgggcccacccgcaagcattaccagccctatgccccaccacgcgacttcgcagcctatcgctccagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 66 - protein, 978 aa, Artificial Sequence
  Synthetic Sequence
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIQLTQSPAILSASPGEKVTMTCRASSSLSFMHWYQQKPGSSPKPWIYATSNLASGVPARFSGSGSGTSYSLTISTVEAEDAASYFCHQWSSNPLTFGAGTKLEISSGGGGSGGGGSGDVMGVDSGGGLVQPGGSRKLSCAAPGFTFSSFGMHWVRQAPEKGLEWVAYISSPSSTLHYADRVKGRFTISRDNPKNTLFLQMKLPSLCYGLLGPRDHVHTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 67 - DNA, 3010 bp, Artificial Sequence
  Synthetic Sequence
gcgatcgcatggccttaccagtgaccgccttgctcctgccgctggccttgctgctccacgccgccaggccggaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccctgcccgtgaccgccctgctgctgcccctggccctgctgctgcacgccgccaggcccgacgtgcagatcacccagagccccagctacctggccgccagccccggcgagaccatcaccatcaactgcagagccagcaagagcatcagcaaggacctggcctggtaccaggagaagcccggcaagaccaacaagctgctgatctacagcggcagcaccctgcagagcggcatccccagcagattcagcggcagcggcagcggcaccgacttcaccctgaccatcagcagcctggagcccgaggacttcgccatgtactactgccagcagcacaacaagtacccctacaccttcggcggcggcaccaagctggagatcaagggaggggggggatccgggggaggaggctccggcggaggcggaagccaggtgcagctgcagcagcccggcgccgagctggtgagacccggcgccagcgtgaagctgagctgcaaggccagcggctacaccttcaccagctactggatgaactgggtgaagcagagacccgaccagggcctggagtggatcggcagaatcgacccctacgacagcgagacccactacaaccagaagttcaaggacaaggccatcctgaccgtggacaagagcagcagcaccgcctacatgcagctgagcagcctgaccagcgaggacagcgccgtgtactactgcgccagaggcaactgggacgactactggggccagggcaccaccctgaccgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaggagtaagaggagcaggctcctgcacagtgactacatgaacatgactccccgccgccccgggcccacccgcaagcattaccagccctatgccccaccacgcgacttcgcagcctatcgctccagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 68 - protein, 997 aa, Artificial Sequence
  Synthetic Sequence
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDVQITQSPSYLAASPGETITINCRASKSISKDLAWYQEKPGKTNKLLIYSGSTLQSGIPSRFSGSGSGTDFTLTISSLEPEDFAMYYCQQHNKYPYTFGGGTKLEIKGGGGSGGGGSGGGGSQVQLQQPGAELVRPGASVKLSCKASGYTFTSYWMNWVKQRPDQGLEWIGRIDPYDSETHYNQKFKDKAILTVDKSSSTAYMQLSSLTSEDSAVYYCARGNWDDYWGQGTTLTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 69 - DNA, 1767 bp, Artificial Sequence
  Synthetic Sequence
gcgatcgctgacctctagaatgtatttgtggcttaaactcttggcatttggctttgcctttctggacacagaagtatttgtgacaggggacatccaggtgacccagagccccagcagcctgagcgccagcctgggcgagagaatcagcctgacctgcagaaccagccaggacatcagcaactacctgaactggttccagcagaagcccgacggcaccttcaagagactgatctacgccaccagcagcctggacagcggcgtgcccaagagattcagcggcagcggcagcggcagcgactacagcctgaccatcagcagcctggagagcgaggacttcgccgactactactgcctgcagtacgccagctaccccttcaccttcggcagcggcaccaagctggagatcaagggaggggggggatccgggggaggaggctccggcggaggcggaagcgaggtgcagctgcaggagagcggccccggcctggtgaagcccagccagaccctgagcctgacctgcagcgtgaccggctacagcatcaccagcggctactactggcactggatcagacagttccccggcaacaagctgcagtggatgggctacatcagctacagcggcttcaccaactacaagaccagcctgatcaacagaatcagcatcacccacgacaccagcgagaaccagttcttcctgaacctgaacagcgtgaccaccgaggacaccgccacctactactgcgccggcgacagaaccggcagctggttcgcctactggggccagggcaccctggtgaccgtgagcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatgtacctgtggctgaagctgctggccttcggcttcgccttcctggacaccgaggtgttcgtgaccggcggccagaacgacaccagccagaccagcagccccagcagcccgctgtttccgggcccgagcaaaccgttttgggtgctggtggtggtgggcggcgtgctggcgtgctatagcctgctggtgaccgtggcgtttattattttttgggtgtaagtttaaac

SEQ ID NO: 70 - protein, 579 aa, Artificial Sequence
  Synthetic Sequence
MYLWLKLLAFGFAFLDTEVFVTGDIQVTQSPSSLSASLGERISLTCRTSQDISNYLNWFQQKPDGTFKRLIYATSSLDSGVPKRFSGSGSGSDYSLTISSLESEDFADYYCLQYASYPFTFGSGTKLEIKGGGGSGGGGSGGGGSEVQLQESGPGLVKPSQTLSLTCSVTGYSITSGYYWHWIRQFPGNKLQWMGYISYSGFTNYKTSLINRISITHDTSENQFFLNLNSVTTEDTATYYCAGDRTGSWFAYWGQGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMYLWLKLLAFGFAFLDTEVFVTGGQNDTSQTSSPSSPLFPGPSKPFWVLVVVGGVLACYSLLVTVAFIIFWV

SEQ ID NO: 71 - DNA, 1880 bp, Artificial Sequence
  Synthetic Sequence
atgtacctgtggctgaagctgctggccttcggcttcgccttcctggacaccgaggtgttcgtgaccggcgacatccaggtgacccagagccccagcagcctgagcgccagcctgggcgagagaatcagcctgacctgcagaaccagccaggacatcagcaactacctgaactggttccagcagaagcccgacggcaccttcaagagactgatctacgccaccagcagcctggacagcggcgtgcccaagagattcagcggcagcggcagcggcagcgactacagcctgaccatcagcagcctggagagcgaggacttcgccgactactactgcctgcagtacgccagctaccccttcaccttcggcagcggcaccaagctggagatcaagggaggggggggatccgggggaggaggctccggcggaggcggaagcgaggtgcagctgcaggagagcggccccggcctggtgaagcccagccagaccctgagcctgacctgcagcgtgaccggctacagcatcaccagcggctactactggcactggatcagacagttccccggcaacaagctgcagtggatgggctacatcagctacagcggcttcaccaactacaagaccagcctgatcaacagaatcagcatcacccacgacaccagcgagaaccagttcttcctgaacctgaacagcgtgaccaccgaggacaccgccacctactactgcgccggcgacagaaccggcagctggttcgcctactggggccagggcaccctggtgaccgtgagcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcatcgatggcagcggcgagggcaggggcagcctgctgacctgcggcgacgtggaggagaaccccggccccatggccttaccagtgaccgccttgctcctgccgctggccttgctgctccacgccgccaggccgggccagaacgacaccagccagaccagcagccccagcagccccctgttccccggccccagcaagcccttctgggtgctggtggtggtgggcggcgtgctggcctgctacagcctgctggtgaccgtggccttcatcatcttctgggtgaggagctaagtttaaac

SEQ ID NO: 72 - protein, 623 aa, Artificial Sequence
  Synthetic Sequence
MYLWLKLLAFGFAFLDTEVFVTGDIQVTQSPSSLSASLGERISLTCRTSQDISNYLNWFQQKPDGTFKRLIYATSSLDSGVPKRFSGSGSGSDYSLTISSLESEDFADYYCLQYASYPFTFGSGTKLEIKGGGGSGGGGSGGGGSEVQLQESGPGLVKPSQTLSLTCSVTGYSITSGYYWHWIRQFPGNKLQWMGYISYSGFTNYKTSLINRISITHDTSENQFFLNLNSVTTEDTATYYCAGDRTGSWFAYWGQGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRIDGSGEGRGSLLTCGDVEENPGPMALPVTALLLPLALLLHAARPGQNDTSQTSSPSSPLFPGPSKPFWVLVVVGGVLACYSLLVTVAFIIFWVRS

SEQ ID NO: 73 - DNA, 2314 bp, Artificial Sequence; identical to SEQ ID NO: 41
  Synthetic Sequence

SEQ ID NO: 74 - protein, 765 aa, Artificial Sequence; identical to SEQ ID NO: 42
  Synthetic Sequence

SEQ ID NO: 75 - DNA, 2371 bp, Artificial Sequence; identical to SEQ ID NO: 43
  Synthetic Sequence

SEQ ID NO: 76 - protein, 784 aa, Artificial Sequence; identical to SEQ ID NO: 44
  Synthetic Sequence

SEQ ID NO: 77 - DNA, 1223 bp, Artificial Sequence
  Synthetic Sequence
gcgatcgctgccatcgataccatgtatttgtggcttaaactcttggcatttggctttgcctttctggacacagaagtatttgtgacaggggccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 78 - protein, 397 aa, Artificial Sequence
  Synthetic Sequence
MYLWLKLLAFGFAFLDTEVFVTGAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLLTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 79 - DNA, 1214 bp, Artificial Sequence
  Synthetic Sequence
gcgatcgctgccatcgataccatggccttaccagtgaccgccttgctcctgccgctggccttgctgctccacgccgccaggccggttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 80 - protein, 394 aa, Artificial Sequence
  Synthetic Sequence
MALPVTALLLPLALLLHAARPVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLLTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 81 - DNA, 2039 bp, Artificial Sequence
  Synthetic Sequence
gcgatcgctgccatcgataccatggccttaccagtgaccgccttgctcctgccgctggccttgctgctccacgccgccaggccggttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataagtttaaac

SEQ ID NO: 82 - protein, 669 aa, Artificial Sequence
  Synthetic Sequence
MALPVTALLLPLALLLHAARPVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLLTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 83 - DNA, 2096 bp, Artificial Sequence
  Synthetic Sequence
gcgatcgctgccatcgataccatggccttaccagtgaccgccttgctcctgccgctggccttgctgctccacgccgccaggccggttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 84 - protein, 688 aa, Artificial Sequence
  Synthetic Sequence
MALPVTALLLPLALLLHAARPVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLLTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 85 - DNA, 2755 bp, Artificial Sequence
  Synthetic Sequence
gcgatcgcaccatggccctgcccgtgaccgccctgctgctgcccctggccctgctgctgcacgccgccaggcccgccgttcagggtccagaagaaacagtcactcaagactgcttgcaactgattgcagacagtgaaacaccaactatacaaaaaggatcttacacatttgttccatggcttctcagctttaaaaggggaagtgccctagaagaaaaagagaataaaatattggtcaaagaaactggttacttttttatatatggtcaggttttatatactgataagacctacgccatgggacatctaattcagaggaagaaggtccatgtctttggggatgaattgagtctggtgactttgtttcgatgtattcaaaatatgcctgaaacactacccaataattcctgctattcagctggcattgcaaaactggaagaaggagatgaactccaacttgcaataccaagagaaaatgcacaaatatcactggatggagatgtcacattttttggtgcattgaaactgctgaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccttaccagtgaccgccttgctcctgccgctggccttgctgctccacgccgccaggccggaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 86 - protein, 911 aa, Artificial Sequence
  Synthetic Sequence
MALPVTALLLPLALLLHAARPAVQGPEETVTQDCLQLIADSETPTIQKGSYTFVPWLLSFKRGSALEEKENKILVKETGYFFIYGQVLYTDKTYAMGHLIQRKKVHVFGDELSLVTLFRCIQNMPETLPNNSCYSAGIAKLEEGDELQLAIPRENAQISLDGDVTFFGALKLLTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 87 - DNA, 2734 bp, Artificial Sequence
  Synthetic Sequence
gcgatcgcaccatggccttaccagtgaccgccttgctcctgccgctggccttgctgctccacgccgccaggccggtgctcacccaaaaacagaagaagcagcactctgtcctgcacctggttcccattaacgccacctccaaggatgactccgatgtgacagaggtgatgtggcaaccagctcttaggcgtgggagaggcctacaggcccaaggatatggtgtccgaatccaggatgctggagtttatctgctgtatagccaggtcctgtttcaagacgtgactttcaccatgggtcaggtggtgtctcgagaaggccaaggaaggcaggagactctattccgatgtataagaagtatgccctcccacccggaccgggcctacaacagctgctatagcgcaggtgtcttccatttacaccaaggggatattctgagtgtcataattccccgggcaagggcgaaacttaacctctctccacatggaaccttcctggggtttgtgaaactgaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccttaccagtgaccgccttgctcctgccgctggccttgctgctccacgccgccaggccggaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 88 - protein, 904 aa, Artificial Sequence
  Synthetic Sequence
MALPVTALLLPLALLLHAARPVLTQKQKKQHSVLHLVPINATSKDDSDVTEVMWQPALRRGRGLQAQGYGVRIQDAGVYLLYSQVLFQDVTFTMGQVVSREGQGRQETLFRCIRSMPSHPDRAYNSCYSAGVFHLHQGDILSVIIPRARAKLNLSPHGTFLGFVKLTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 89 - DNA, 1498 bp, Artificial Sequence
  Synthetic Sequence
gcgatcgcatggccttaccagtgaccgccttgctcctgccgctggccttgctgctccacgccgccaggccggacatcgtgatgacccaaagccccgacagcctggccgtgagcctgggcgagagggtgaccatgaactgcaaaagcagccagtccctgctgtactccaccaaccagaagaactacctggcttggtatcaacagaagcccggacagagccccaagctgctgatctattgggccagcactagggaaagcggcgtgcccgataggttcagcggcagcgggagcggcacagacttcactctgaccattagcagcgtgcaggctgaggatgtggccgtctactactgccagcagtactacagctacaggacctttgggggcggaactaagctggagatcaagggaggggggggatccgggggaggaggctccggcggaggcggaagccaagtgcaactgcagcagagcggcccagaggtggtcaaacctggggcaagcgtgaagatgagctgcaaggctagcggctataccttcaccagctatgtgatccactgggtgaggcagaaaccaggacagggcctggactggatcggctacatcaacccctacaatgacggcaccgattatgacgaaaaattcaaggggaaggccaccctgaccagcgacaccagcacaagcaccgcctacatggagctgtccagcctgaggtccgaggacaccgccgtgtattactgtgccagggagaaggacaattacgccaccggcgcttggttcgcctactggggccagggcacactggtgacagtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 90 - protein, 493 aa, Artificial Sequence
  Synthetic Sequence
MALPVTALLLPLALLLHAARPDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 91 - DNA, 2560 bp, Artificial Sequence
  Synthetic Sequence
gcgatcgcatgtatttgtggcttaaactcttggcatttggctttgcctttctggacacagaagtatttgtgacaggggacatcgtgatgacccaaagccccgacagcctggccgtgagcctgggcgagagggtgaccatgaactgcaaaagcagccagtccctgctgtactccaccaaccagaagaactacctggcttggtatcaacagaagcccggacagagccccaagctgctgatctattgggccagcactagggaaagcggcgtgcccgataggttcagcggcagcgggagcggcacagacttcactctgaccattagcagcgtgcaggctgaggatgtggccgtctactactgccagcagtactacagctacaggacctttgggggcggaactaagctggagatcaagggaggggggggatccgggggaggaggctccggcggaggcggaagccaagtgcaactgcagcagagcggcccagaggtggtcaaacctggggcaagcgtgaagatgagctgcaaggctagcggctataccttcaccagctatgtgatccactgggtgaggcagaaaccaggacagggcctggactggatcggctacatcaacccctacaatgacggcaccgattatgacgaaaaattcaaggggaaggccaccctgaccagcgacaccagcacaagcaccgcctacatggagctgtccagcctgaggtccgaggacaccgccgtgtattactgtgccagggagaaggacaattacgccaccggcgcttggttcgcctactggggccagggcacactggtgacagtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggcccctacctgtggctgaagctgctggccttcggcttcgccttcctggacaccgaggtgttcgtgaccggcgacatccagatgacccagagccccagcaccctgagcgccagcgtgggcgacagggtgaccatcacctgcagcgccagcagcagcatcagctacatgcactggtaccagcagaagcccggcaaggcccccaagctgctgatctacaccaccagcaacctggccagcggcgtgcccgccaggttcagcggcagcggcagcggcaccgagttcaccctgaccatcagcagcctgcagcccgacgacttcgccacctactactgccaccagaggagcacctaccccctgaccttcggccagggcaccaaggtggaggtgaagggcggcggcggcagcggcggcggcggcagcggcggcggcggcagccaggtgcagctggtgcagagcggcgccgaggtgaagaagcccggcagcagcgtgaaggtgagctgcaaggccagcggctacaccttcaccagctacaggatgcactgggtgaggcaggcccccggccagggcctggagtggatcggctacatcaaccccagcaccggctacaccgagtacaaccagaagttcaaggacaaggccaccatcaccgccgacgagagcaccaacaccgcctacatggagctgagcagcctgaggagcgaggacaccgccgtgtactactgcgccaggggcggcggcgtgttcgactactggggccagggcaccctggtgaccgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctaagtttaaac

SEQ ID NO: 92 - protein, 847 aa, Artificial Sequence
  Synthetic Sequence
MYLWLKLLAFGFAFLDTEVFVTGDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTTTPAPRPPTPAPTIASQPLSLRPEACRPAAGGAVHTRGLDFACDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPYLWLKLLAFGFAFLDTEVFVTGDIQMTQSPSTLSASVGDRVTITCSASSSISYMHWYQQKPGKAPKLLIYTTSNLASGVPARFSGSGSGTEFTLTISSLQPDDFATYYCHQRSTYPLTFGQGTKVEVKGGGGSGGGGSGGGGSQVQLVQSGAEVKKPGSSVKVSCKASGYTFTSYRMHWVRQAPGQGLEWIGYINPSTGYTEYNQKFKDKATITADESTNTAYMELSSLRSEDTAVYYCARGGGVFDYWGQGTLVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRS

SEQ ID NO: 93 - DNA, 2551 bp, Artificial Sequence
  Synthetic Sequence
gcgatcgcatggccttaccagtgaccgccttgctcctgccgctggccttgctgctccacgccgccaggccggacatcgtgatgacccaaagccccgacagcctggccgtgagcctgggcgagagggtgaccatgaactgcaaaagcagccagtccctgctgtactccaccaaccagaagaactacctggcttggtatcaacagaagcccggacagagccccaagctgctgatctattgggccagcactagggaaagcggcgtgcccgataggttcagcggcagcgggagcggcacagacttcactctgaccattagcagcgtgcaggctgaggatgtggccgtctactactgccagcagtactacagctacaggacctttgggggcggaactaagctggagatcaagggaggggggggatccgggggaggaggctccggcggaggcggaagccaagtgcaactgcagcagagcggcccagaggtggtcaaacctggggcaagcgtgaagatgagctgcaaggctagcggctataccttcaccagctatgtgatccactgggtgaggcagaaaccaggacagggcctggactggatcggctacatcaacccctacaatgacggcaccgattatgacgaaaaattcaaggggaaggccaccctgaccagcgacaccagcacaagcaccgcctacatggagctgtccagcctgaggtccgaggacaccgccgtgtattactgtgccagggagaaggacaattacgccaccggcgcttggttcgcctactggggccagggcacactggtgacagtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccctgcccgtgaccgccctgctgctgcccctggccctgctgctgcacgccgccaggcccgacatccagatgacccagagccccagcaccctgagcgccagcgtgggcgacagggtgaccatcacctgcagcgccagcagcagcatcagctacatgcactggtaccagcagaagcccggcaaggcccccaagctgctgatctacaccaccagcaacctggccagcggcgtgcccgccaggttcagcggcagcggcagcggcaccgagttcaccctgaccatcagcagcctgcagcccgacgacttcgccacctactactgccaccagaggagcacctaccccctgaccttcggccagggcaccaaggtggaggtgaagggcggcggcggcagcggcggcggcggcagcggcggcggcggcagccaggtgcagctggtgcagagcggcgccgaggtgaagaagcccggcagcagcgtgaaggtgagctgcaaggccagcggctacaccttcaccagctacaggatgcactgggtgaggcaggcccccggccagggcctggagtggatcggctacatcaaccccagcaccggctacaccgagtacaaccagaagttcaaggacaaggccaccatcaccgccgacgagagcaccaacaccgcctacatggagctgagcagcctgaggagcgaggacaccgccgtgtactactgcgccaggggcggcggcgtgttcgactactggggccagggcaccctggtgaccgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctaagtttaaac

SEQ ID NO: 94 - protein, 844 aa, Artificial Sequence
  Synthetic Sequence
MALPVTALLLPLALLLHAARPDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTTTPAPRPPTPAPTIASQPLSLRPEACRPAAGGAVHTRGLDFACDIYIWAPLAGTCGVLLLSLVITLYCRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIQMTQSPSTLSASVGDRVTITCSASSSISYMHWYQQKPGKAPKLLIYTTSNLASGVPARFSGSGSGTEFTLTISSLQPDDFATYYCHQRSTYPLTFGQGTKVEVKGGGGSGGGGSGGGGSQVQLVQSGAEVKKPGSSVKVSCKASGYTFTSYRMHWVRQAPGQGLEWIGYINPSTGYTEYNQKFKDKATITADESTNTAYMELSSLRSEDTAVYYCARGGGVFDYWGQGTLVTVSSTTTPAPRPPTPAPTIASQPLSLRPEACRPAAGGAVHTRGLDFACDFWVLVVVGGVLACYSLLVTVAFIIFWVRSKRSRLLHSDYMNMTPRRPGPTRKHYQPYAPPRDFAAYRS

SEQ ID NO: 95 - DNA, 2149 bp, Artificial Sequence
  Synthetic Sequence
gcgatcgcatggccttaccagtgaccgccttgctcctgccgctggccttgctgctccacgccgccaggccggacatcgtgatgacccaaagccccgacagcctggccgtgagcctgggcgagagggtgaccatgaactgcaaaagcagccagtccctgctgtactccaccaaccagaagaactacctggcttggtatcaacagaagcccggacagagccccaagctgctgatctattgggccagcactagggaaagcggcgtgcccgataggttcagcggcagcgggagcggcacagacttcactctgaccattagcagcgtgcaggctgaggatgtggccgtctactactgccagcagtactacagctacaggacctttgggggcggaactaagctggagatcaagggaggggggggatccgggggaggaggctccggcggaggcggaagccaagtgcaactgcagcagagcggcccagaggtggtcaaacctggggcaagcgtgaagatgagctgcaaggctagcggctataccttcaccagctatgtgatccactgggtgaggcagaaaccaggacagggcctggactggatcggctacatcaacccctacaatgacggcaccgattatgacgaaaaattcaaggggaaggccaccctgaccagcgacaccagcacaagcaccgcctacatggagctgtccagcctgaggtccgaggacaccgccgtgtattactgtgccagggagaaggacaattacgccaccggcgcttggttcgcctactggggccagggcacactggtgacagtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctaagtttaaac

SEQ ID NO: 96 - protein, 710 aa, Artificial Sequence
  Synthetic Sequence
MALPVTALLLPLALLLHAARPDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 97 - DNA, 2623 bp, Artificial Sequence
  Synthetic Sequence
gcgatcgcatggccttaccagtgaccgccttgctcctgccgctggccttgctgctccacgccgccaggccggacatcgtgatgacccaaagccccgacagcctggccgtgagcctgggcgagagggtgaccatgaactgcaaaagcagccagtccctgctgtactccaccaaccagaagaactacctggcttggtatcaacagaagcccggacagagccccaagctgctgatctattgggccagcactagggaaagcggcgtgcccgataggttcagcggcagcgggagcggcacagacttcactctgaccattagcagcgtgcaggctgaggatgtggccgtctactactgccagcagtactacagctacaggacctttgggggcggaactaagctggagatcaagggaggggggggatccgggggaggaggctccggcggaggcggaagccaagtgcaactgcagcagagcggcccagaggtggtcaaacctggggcaagcgtgaagatgagctgcaaggctagcggctataccttcaccagctatgtgatccactgggtgaggcagaaaccaggacagggcctggactggatcggctacatcaacccctacaatgacggcaccgattatgacgaaaaattcaaggggaaggccaccctgaccagcgacaccagcacaagcaccgcctacatggagctgtccagcctgaggtccgaggacaccgccgtgtattactgtgccagggagaaggacaattacgccaccggcgcttggttcgcctactggggccagggcacactggtgacagtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcagatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagaaccaccacccccgcccccaggccccccacccccgcccccaccatcgccagccagcccctgagcctgaggcccgaggcctgcaggcccgccgccggcggcgccgtgcacaccaggggcctggacttcgcctgcgacgtggctatctccacgtccactgtcctgctgtgtgggctgagcgctgtgtctctcctggcatgctactaagtttaaac

SEQ ID NO: 98 - protein, 868 aa, Artificial Sequence
  Synthetic Sequence
MALPVTALLLPLALLLHAARPDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRTTTPAPRPPTPAPTIASQPLSLRPEACRPAAGGAVHTRGLDFACDVAISTSTVLLCGLSAVSLLACY

SEQ ID NO: 99 - DNA, 2389 bp, Artificial Sequence
  Synthetic Sequence
gcgatcgcaccatggccttaccagtgaccgccttgctcctgccgctggccttgctgctccacgccgccaggccggacatcgtgatgagccagagccccagcagcctggccgtgagcgtgggcgagaagttcaccgtgaactgcaagagcagccagagcctgctgtacagcagcaaccagaagaacttcctggcctggtaccagcagaagcccggccagagccccaagctgctgatctactgggccagcaccagagagagcggcgtgcccgacagattcatcggcagcggcagcggcaccgacttcaccctgaccatcagcagcgtgaaggccgaggacctggccgtgtactactgccagcagcactacagatacccctggaccttcggcggcggcaccaagctggagatcaagagagccagaggaggggggggatccgggggaggaggctccggcggaggcggaagccaggtgaccctgaaggagagcggccccggcatcctgcagcccagccagaccctgagcctgacctgcagcttcagcggcttcagcctgaacaccagcggcgtgggcgtgggctggatcagacagcccagcggcaagggcctggagtggctggcccacatctggtgggacgacgacgagagatacaaccccgtgctgaagagcagactgaccatcagcaaggacaccagcagcaaccaggtgttcctgaagatcgccaacgtggacaccgccgacagcgccacctactactgcgtgagaagcatggtggcctggttcttcccctactggggcagaggcaccctggtgaccgtgagcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 100 - protein, 789 aa, Artificial Sequence
  Synthetic Sequence
MALPVTALLLPLALLLHAARPDIVMSQSPSSLAVSVGEKFTVNCKSSQSLLYSSNQKNFLAWYQQKPGQSPKLLIYWASTRESGVPDRFIGSGSGTDFTLTISSVKAEDLAVYYCQQHYRYPWTFGGGTKLEIKRARGGGGSGGGGSGGGGSQVTLKESGPGILQPSQTLSLTCSFSGFSLNTSGVGVGWIRQPSGKGLEWLAHIWWDDDERYNPVLKSRLTISKDTSSNQVFLKIANVDTADSATYYCVRSMVAWFFPYWGRGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 101 - DNA, 2371 bp, Artificial Sequence
  Synthetic Sequence
gcgatcgcaccatggccttaccagtgaccgccttgctcctgccgctggccttgctgctccacgccgccaggccggacattatgatgacacagtcgccatcatctctggctgtgtctgcaggagaaaaggtcactatgacctgtaagtccagtcaaagtgttttatacagttcaaatcagaagaactacttggcctggtaccagcagaaaccagggcagtctcctaaactactgatctactgggcatccactagggaatctggtgtccctgatcgcttcacaggcagtggatctgggacagattttactcttaccatcagcagtgtgcaacctgaagacctggcagtttattactgtcatcaatacctctcctcgcacacgttcggaggggggaccaagctggaaataaaacggggtggcggtggctcgggcggtggtgggtcgggtggcggcggatctcaactgcagcagcctggggctgagctggtgaggcctgggtcttcagtgaagctgtcctgcaaggcttctggctacaccttcaccaggtactggatacattgggtgaagcagaggcctatacaaggccttgaatggattggtaacattgatccttctgatagtgaaactcactacaatcaaaagttcaaggacaaggccacattgactgtagacaaatcctccggcacagcctacatgcagctcagcagcctgacatctgaggactctgcggtctattactgtgcaacagaggatctttactatgctatggagtactggggtcaaggaacctcagtcaccgtctcctctaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 102 - protein, 783 aa, Artificial Sequence
  Synthetic Sequence
MALPVTALLLPLALLLHAARPDIMMTQSPSSLAVSAGEKVTMTCKSSQSVLYSSNQKNYLAWYQQKPGQSPKLLIYWASTRESGVPDRFTGSGSGTDFTLTISSVQPEDLAVYYCHQYLSSHTFGGGTKLEIKRGGGGSGGGGSGGGGSQLQQPGAELVRPGSSVKLSCKASGYTFTRYWIHWVKQRPIQGLEWIGNIDPSDSETHYNQKFKDKATLTVDKSSGTAYMQLSSLTSEDSAVYYCATEDLYYAMEYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 103 - DNA, 2356 bp, Artificial Sequence
  Synthetic Sequence
gcgatcgcaccatggccttaccagtgaccgccttgctcctgccgctggccttgctgctccacgccgccaggccggacatccagatgacccagagccccagcagcctgagcgccagcgtgggcgacagagtgaccatcacctgcagcgccagcagcagcgtgagctacatgaactggtaccagcagacccccggcaaggcccccaagagatggatctacgacaccagcaagctggccagcggcgtgcccagcagattcagcggcagcggcagcggcaccgactacaccttcaccatcagcagcctgcagcccgaggacatcgccacctactactgccagcagtggagcagcaaccccttcaccttcggccagggcaccaagctgcagatcggcggcggcggcagcggcggcggcggcagcggcggcggcggcagccaggtgcagctggtgcagagcggcggcggcgtggtgcagcccggcagaagcctgagactgagctgcaaggccagcggctacaccttcaccagatacaccatgcactgggtgagacaggcccccggcaagggcctggagtggatcggctacatcaaccccagcagaggctacaccaactacaaccagaaggtgaaggacagattcaccatcagcagagacaacagcaagaacaccgccttcctgcagatggacagcctgagacccgaggacaccggcgtgtacttctgcgccagatactacgacgaccactactgcctggactactggggccagggcacccccgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 104 - protein, 777 aa, Artificial Sequence
  Synthetic Sequence
MALPVTALLLPLALLLHAARPDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQIGGGGSGGGGSGGGGSQVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCI

SEQ ID NO: 105 - DNA, 2401 bp, Artificial Sequence
  Synthetic Sequence
gcgatcgcaccatggccttaccagtgaccgccttgctcctgccgctggccttgctgctccacgccgccaggccgggcgcccagcccgccatggccgcctacaaggacatccagatgacccagaccaccagcagcctgagcgccagcctgggcgacagagtgaccatcagctgcagcgccagccagggcatcagcaactacctgaactggtaccagcagaagcccgacggcaccaacaagctgctgatctactacaccagcagcctgcacagcggcgtgcccagcagattcagcggcagcggcagcggcaccgactacagcctgcacagcaacctggagcccgaggacatcgccacctactactgccagcagtacagcaagctgccctacaccttcggcggcggcaccaagctggagatcaagagaggcggcggcggcagcggcggcggcggcagcggcggcggcggcagcggcggcggcggcagcgaggtgcagctggtggagagcggcggcggcctggtgaagcccggcggcagcctgaagctgagctgcgccgccagcggcctgaccttcagcagctacgccatgagctggaacagacagacccccgagaagagactggagtgggtggccagcatcagcagcggcggcttcacctactaccccgacagcaacaagggcagattcaccatcagcagagacaacgccagaaacatcctgtacctgcagatgagcagcctgagaagcgaggacaccgccatgtactactgcgccagagacgaggtgagaggctacctggacgtgtggggcgccggcaccaccgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 106 - protein, 793 aa, Artificial Sequence
  Synthetic Sequence
MALPVTALLLPLALLLHAARPGAQPAMAAYKDIQMTQTTSSLSASLGDRVTISCSASQGISNYLNWYQQKPDGTNKLLIYYTSSLHSGVPSRFSGSGSGTDYSLHSNLEPEDIATYYCQQYSKLPYTFGGGTKLEIKRGGGGSGGGGSGGGGSGGGGSEVQLVESGGGLVKPGGSLKLSCAASGLTFSSYAMSWNRQTPEKRLEWVASISSGGFTYYPDSNKGRFTISRDNARNILYLQMSSLRSEDTAMYYCARDEVRGYLDVWGAGTTVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 107 - DNA, 2359 bp, Artificial Sequence
  Synthetic Sequence
gcgatcgcaccatggccttaccagtgaccgccttgctcctgccgctggccttgctgctccacgccgccaggccggacatccaggtgacccagagccccagcagcctgagcgccagcctgggcgagagaatcagcctgacctgcagaaccagccaggacatcagcaactacctgaactggttccagcagaagcccgacggcaccttcaagagactgatctacgccaccagcagcctggacagcggcgtgcccaagagattcagcggcagcggcagcggcagcgactacagcctgaccatcagcagcctggagagcgaggacttcgccgactactactgcctgcagtacgccagctaccccttcaccttcggcagcggcaccaagctggagatcaagggaggggggggatccgggggaggaggctccggcggaggcggaagcgaggtgcagctgcaggagagcggccccggcctggtgaagcccagccagaccctgagcctgacctgcagcgtgaccggctacagcatcaccagcggctactactggcactggatcagacagttccccggcaacaagctgcagtggatgggctacatcagctacagcggcttcaccaactacaagaccagcctgatcaacagaatcagcatcacccacgacaccagcgagaaccagttcttcctgaacctgaacagcgtgaccaccgaggacaccgccacctactactgcgccggcgacagaaccggcagctggttcgcctactggggccagggcaccctggtgaccgtgagcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 108 - protein, 779 aa, Artificial Sequence
  Synthetic Sequence
MALPVTALLLPLALLLHAARPDIQVTQSPSSLSASLGERISLTCRTSQDISNYLNWFQQKPDGTFKRLIYATSSLDSGVPKRFSGSGSGSDYSLTISSLESEDFADYYCLQYASYPFTFGSGTKLEIKGGGGSGGGGSGGGGSEVQLQESGPGLVKPSQTLSLTCSVTGYSITSGYYWHWIRQFPGNKLQWMGYISYSGFTNYKTSLINRISITHDTSENQFFLNLNSVTTEDTATYYCAGDRTGSWFAYWGQGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 109 - protein, 21 aa, Artificial Sequence
  Synthetic Sequence
MALPVTALLLPLALLLHAARP

SEQ ID NO: 110 - protein, 116 aa, Artificial Sequence
  Synthetic Sequence
DIVMSQSPSSLAVSVGEKFTVNCKSSQSLLYSSNQKNFLAWYQQKPGQSPKLLIYWASTRESGVPDRFIGSGSGTDFTLTISSVKAEDLAVYYCQQHYRYPWTFGGGTKLEIKRAR

SEQ ID NO: 111 - protein, 15 aa, Artificial Sequence
  Synthetic Sequence
GGGGSGGGGSGGGGS

SEQ ID NO: 112 - protein, 119 aa, Artificial Sequence
  Synthetic Sequence
QVTLKESGPGILQPSQTLSLTCSFSGFSLNTSGVGVGWIRQPSGKGLEWLAHIWWDDDERYNPVLKSRLTISKDTSSNQVFLKIANVDTADSATYYCVRSMVAWFFPYWGRGTLVTVSA

SEQ ID NO: 113 - protein, 45 aa, Artificial Sequence
  Synthetic Sequence
TTTPAPRPPTPAPTIASQPLSLRPEACRPAAGGAVHTRGLDFACD

SEQ ID NO: 114 - protein, 24 aa, Artificial Sequence
  Synthetic Sequence
IYIWAPLAGTCGVLLLSLVITLYC

SEQ ID NO: 115 - protein, 41 aa, Artificial Sequence
  Synthetic Sequence
RSKRSRLLHSDYMNMTPRRPGPTRKHYQPYAPPRDFAAYRS

SEQ ID NO: 116 - protein, 113 aa, Artificial Sequence
  Synthetic Sequence
RVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 117 - protein, 22 aa, Artificial Sequence
  Synthetic Sequence
GSGATNFSLLKQAGDVEENPGP

SEQ ID NO: 118 - protein, 20 aa, Artificial Sequence
  Synthetic Sequence
MYRMQLLSCIALSLALVTNS

SEQ ID NO: 119 - protein, 21 aa, Artificial Sequence
  Synthetic Sequence
GIHVFILGCFSAGLPKTEANW

SEQ ID NO: 120 - protein, 50 aa, Artificial Sequence
  Synthetic Sequence
VNVISDLKKIEDLIQSMHIDATLYTESDVHPSCKVTAMKCFLLELQVISL

SEQ ID NO: 121 - protein, 50 aa, Artificial Sequence
  Synthetic Sequence
ESGDASIHDTVENLIILANNSLSSNGNVTESGCKECEELEEKNIKEFLQS

SEQ ID NO: 122 - protein, 12 aa, Artificial Sequence
  Synthetic Sequence
FVHIVQMFINTS

SEQ ID NO: 123 - protein, 26 aa, Artificial Sequence
  Synthetic Sequence
SGGGSGGGGSGGGGSGGGGSGGGSLQ

SEQ ID NO: 124 - protein, 29 aa, Artificial Sequence
  Synthetic Sequence
APRRARGCRTLGLPALLLLLLLRPPATRG

SEQ ID NO: 125 - protein, 65 aa, Artificial Sequence
  Synthetic Sequence
ITCPPPMSVEHADIWVKSYSLYSRERYICNSGFKRKAGTSSLTECVLNKATNVAHWTTPSLKCIR

SEQ ID NO: 126 - protein, 787 aa, Artificial Sequence
  (CD19b-28-IL-15/IL-15sushi CAR amino acid sequence)
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 127 - DNA, 2372 bp, Artificial Sequence
  (CD19b-28-IL-15/IL-15sushi CAR nucleotide sequence)
atggccttaccagtgaccgccttgctcctgccgctggccttgctgctccacgccgccaggccggaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 128 - protein, 1024 aa, Artificial Sequence
  (CD19b-BBpre-P2A-CD123b-2G CAR amino acid sequence)
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRGGGGSGGGGSGGGGSGGGGSEVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSASGATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 129 - DNA, 3083 bp, Artificial Sequence
  (CD19b-BBpre-P2A-CD123b-2G CAR nucleotide sequence)
atggccctgcccgtgaccgccctgctgctgcccctggccctgctgctgcacgccgccaggcccgaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaaacggggcagaaagaaactcctgtatatattcaaacaaccatttatgagaccagtacaaactactcaagaggaagatggctgtagctgccgatttccagaagaagaagaaggaggatgtgaactgagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggggaagcggagccaccaacttcagcctgctgaagcaggccggcgacgtggaggagaaccccggccccatggccttaccagtgaccgccttgctcctgccgctggccttgctgctccacgccgccaggccgatggccgactacaaggacatcgtgatgacccagagccacaagttcatgagcaccagcgtgggcgacagggtgaacatcacctgcaaggccagccagaacgtggacagcgccgtggcctggtaccagcagaagcccggccagagccccaaggccctgatctacagcgccagctacaggtacagcggcgtgcccgacaggttcaccggcaggggcagcggcaccgacttcaccctgaccatcagcagcgtgcaggccgaggacctggccgtgtactactgccagcagtactacagcaccccctggaccttcggcggcggcaccaagctggagatcaagaggggcggcggcggcagcggcggcggcggcagcggcggcggcggcagcggcggcggcggcagcgaggtgaagctggtggagagcggcggcggcctggtgcagcccggcggcagcctgagcctgagctgcgccgccagcggcttcaccttcaccgactactacatgagctgggtgaggcagccccccggcaaggccctggagtggctggccctgatcaggagcaaggccgacggctacaccaccgagtacagcgccagcgtgaagggcaggttcaccctgagcagggacgacagccagagcatcctgtacctgcagatgaacgccctgaggcccgaggacagcgccacctactactgcgccagggacgccgcctactacagctactacagccccgagggcgccatggactactggggccagggcaccagcgtgaccgtgagcagcgccagcggcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 130 - protein, 485 aa, Artificial Sequence
  (CD22b-28-2G CAR amino acid sequence)
MALPVTALLLPLALLLHAARPQVQLQESGAELSKPGASVKMSCKASGYTFTSYWLHWIKQRPGQGLEWIGYINPRNDYTEYNQNFKDKATLTADKSSSTAYMQLSSLTSEDSAVYYCARRDITTFYWGQGTTLTVSSGGGGSGGGGSGGGGSDIQLTQSPSSLAVSAGENVTMSCKSSQSVLYSANHKNYLAWYQQKPGQSPKLLIYWASTRESGVPDRFTGSGTDFTLTISRVQVEDLAIYYCHQYLSSWTFGGGTKLEIKRTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 131 - DNA, 1466 bp, Artificial Sequence
  (CD22b-28-2G CAR nucleotide sequence)
atggccctgcccgtgaccgccctgctgctgcccctggccctgctgctgcacgccgccaggccccaggtgcagctgcaggagagcggcgccgagctgagcaagcccggcgccagcgtgaagatgagctgcaaggccagcggctacaccttcaccagctactggctgcactggatcaagcagaggcccggccagggcctggagtggatcggctacatcaaccccaggaacgactacaccgagtacaaccagaacttcaaggacaaggccaccctgaccgccgacaagagcagcagcaccgcctacatgcagctgagcagcctgaccagcgaggacagcgccgtgtactactgcgccaggagggacatcaccaccttctactggggccagggcaccaccctgaccgtgagcagcggaggggggggatccgggggaggaggctccggcggaggcggaagcgacatccagctgacccagagccccagcagcctggccgtgagcgccggcgagaacgtgaccatgagctgcaagagcagccagagcgtgctgtacagcgccaaccacaagaactacctggcctggtaccagcagaagcccggccagagccccaagctgctgatctactgggccagcaccagggagagcggcgtgcccgacaggttcaccggcagcggcaccgacttcaccctgaccatcagcagggtgcaggtggaggacctggccatctactactgccaccagtacctgagcagctggaccttcggcggcggcaccaagctggagatcaagaggaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaggagtaagaggagcaggctcctgcacagtgactacatgaacatgactccccgccgccccgggcccacccgcaagcattaccagccctatgccccaccacgcgacttcgcagcctatcgctccagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagcccaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 132 - protein, 497 aa, Artificial Sequence
  (CD33b-BB-2G CAR amino acid sequence)
MALPVTALLLPLALLLHAARPMADYKDIVMTQSHKFLLVSVGDRVSITCKASQDVSTAVAWYQQKPGQSPKLLIYSASYRYTGVPDRFIGSGSGTDFTLTISSVQAEDLADYFCQQHYSTPLTFGAGTKLEIKRGGGGSGGGGSGGGGSSGGGSEVQLKESGPGLVAPSQSLSITCTVSGFPLTSYGVSWVRQPPGKGLEWLGVIWGDGSTNYHSALISRLSISKDNSKSQVFLKLNNLQTDDTATYYCARDTYYPYYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 133 - DNA, 1494 bp, Artificial Sequence
  (CD33b-BB-2G CAR nucleotide sequence)
atggccctgcccgtgaccgccctgctgctgcccctggccctgctgctgcacgccgccaggcccatggccgactacaaggacatcgtgatgacccagagccacaagttcctgctggtgagcgtgggcgacagggtgagcatcacctgcaaggccagccaggacgtgagcaccgccgtggcctggtaccagcagaagcccggccagagccccaagctgctgatctacagcgccagctacaggtacaccggcgtgcccgacaggttcatcggcagcggcagcggcaccgacttcaccctgaccatcagcagcgtgcaggccgaggacctggccgactacttctgccagcagcactacagcacccccctgaccttcggcgccggcaccaagctggagatcaagaggggcggcggcggcagcggcggcggcggcagcggcggcggcggcagcagcggcggcggcagcgaggtgcagctgaaggagagcggccccggcctggtggcccccagccagagcctgagcatcacctgcaccgtgagcggcttccccctgaccagctacggcgtgagctgggtgaggcagccccccggcaagggcctggagtggctgggcgtgatctggggcgacggcagcaccaactaccacagcgccctgatcagcaggctgagcatcagcaaggacaacagcaagagccaggtgttcctgaagctgaacaacctgcagaccgacgacaccgccacctactactgcgccagggacacctactacccctactacgccatggactactggggccagggcaccagcgtgaccgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaaacggggcagaaagaaactcctgtatatattcaaacaaccatttatgagaccagtacaaactactcaagaggaagatggctgtagctgccgatttccagaagaagaagaaggaggatgtgaactgagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaa

SEQ ID NO: 134 - protein, 1060 aa, Artificial Sequence
  (CD45-28-2G-4-1BBL-IL15RA "super" CAR amino acid sequence)
MALPVTALLLPLALLLHAARPDIVLTQSPASLAVSLGQRATISCRASKSVSTSGYSYLHWYQQKPGQPPKLLIYLASNLESGVPARFSGSGSGTDFTLNIHPVEEEDAATYYCQHSRELPFTFGSGTKLEIKGGGGSGGGGSGGGGSQVQLVESGGGLVQPGGSLKLSCAASGFDFSRYWMSWVRQAPGKGLEWIGEINPTSSTINFTPSLKDKVFISRDNAKNTLYLQMSKVRSEDTALYYCARGNYYRYGDAMDYWGQGTSVTVSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 135 - DNA, 3191 bp, Artificial Sequence
  (CD45-28-2G-4-1BBL-IL15RA sequence, "super" CAR nucleotide sequence)
atggccttaccagtgaccgccttgctcctgccgctggccttgctgctccacgccgccaggccggacatcgtgctgacccagagccccgccagcctggccgtgagcctgggccagagggccaccatcagctgcagggccagcaagagcgtgagcaccagcggctacagctacctgcactggtaccagcagaagcccggccagccccccaagctgctgatctacctggccagcaacctggagagcggcgtgcccgccaggttcagcggcagcggcagcggcaccgacttcaccctgaacatccaccccgtggaggaggaggacgccgccacctactactgccagcacagcagggagctgcccttcaccttcggcagcggcaccaagctggagatcaagggaggggggggatccgggggaggaggctccggcggaggcggaagccaggtgcagctggtggagagcggcggcggcctggtgcagcccggcggcagcctgaagctgagctgcgccgccagcggcttcgacttcagcaggtactggatgagctgggtgaggcaggcccccggcaagggcctggagtggatcggcgagatcaaccccaccagcagcaccatcaacttcacccccagcctgaaggacaaggtgttcatcagcagggacaacgccaagaacaccctgtacctgcagatgagcaaggtgaggagcgaggacaccgccctgtactactgcgccaggggcaactactacaggtacggcgacgccatggactactggggccagggcaccagcgtgaccgtgagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaaggaagcggagctactaacttcagcctgctgaagcaggctggagacgtggaggagaaccctggacctatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 136 - protein, 508 aa, Artificial Sequence
  (CD123b-2G CAR amino acid sequence)
MALPVTALLLPLALLLHAARPMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRGGGGSGGGGSGGGGSGGGGSEVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSASGATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 137 - DNA, 1535 bp, Artificial Sequence
  (CD123b-2G CAR nucleotide sequence)
atggccttaccagtgaccgccttgctcctgccgctggccttgctgctccacgccgccaggccgatggccgactacaaggacatcgtgatgacccagagccacaagttcatgagcaccagcgtgggcgacagggtgaacatcacctgcaaggccagccagaacgtggacagcgccgtggcctggtaccagcagaagcccggccagagccccaaggccctgatctacagcgccagctacaggtacagcggcgtgcccgacaggttcaccggcaggggcagcggcaccgacttcaccctgaccatcagcagcgtgcaggccgaggacctggccgtgtactactgccagcagtactacagcaccccctggaccttcggcggcggcaccaagctggagatcaagaggggcggcggcggcagcggcggcggcggcagcggcggcggcggcagcggcggcggcggcagcgaggtgaagctggtggagagcggcggcggcctggtgcagcccggcggcagcctgagcctgagctgcgccgccagcggcttcaccttcaccgactactacatgagctgggtgaggcagccccccggcaaggccctggagtggctggccctgatcaggagcaaggccgacggctacaccaccgagtacagcgccagcgtgaagggcaggttcaccctgagcagggacgacagccagagcatcctgtacctgcagatgaacgccctgaggcccgaggacagcgccacctactactgcgccagggacgccgcctactacagctactacagccccgagggcgccatggactactggggccagggcaccagcgtgaccgtgagcagcgccagcggcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 138 - protein, 1027 aa, Artificial Sequence
  (CD123b-CD33b-2G CAR amino acid sequence)
MALPVTALLLPLALLLHAARPMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRGGGGSGGGGSGGGGSGGGGSEVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSASGATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPMADYKDIVMTQSHKFLLVSVGDRVSITCKASQDVSTAVAWYQQKPGQSPKLLIYSASYRYTGVPDRFIGSGSGTDFTLTISSVQAEDLADYFCQQHYSTPLTFGAGTKLEIKRGGGGSGGGGSGGGGSSGGGSEVQLKESGPGLVAPSQSLSITCTVSGFPLTSYGVSWVRQPPGKGLEWLGVIWGDGSTNYHSALISRLSISKDNSKSQVFLKLNNLQTDDTATYYCARDTYYPYYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 139 - DNA, 3084 bp, Artificial Sequence
  (CD123b-CD33b-2G CAR nucleotide sequence)
atggccttaccagtgaccgccttgctcctgccgctggccttgctgctccacgccgccaggccgatggccgactacaaggacatcgtgatgacccagagccacaagttcatgagcaccagcgtgggcgacagggtgaacatcacctgcaaggccagccagaacgtggacagcgccgtggcctggtaccagcagaagcccggccagagccccaaggccctgatctacagcgccagctacaggtacagcggcgtgcccgacaggttcaccggcaggggcagcggcaccgacttcaccctgaccatcagcagcgtgcaggccgaggacctggccgtgtactactgccagcagtactacagcaccccctggaccttcggcggcggcaccaagctggagatcaagaggggcggcggcggcagcggcggcggcggcagcggcggcggcggcagcggcggcggcggcagcgaggtgaagctggtggagagcggcggcggcctggtgcagcccggcggcagcctgagcctgagctgcgccgccagcggcttcaccttcaccgactactacatgagctgggtgaggcagccccccggcaaggccctggagtggctggccctgatcaggagcaaggccgacggctacaccaccgagtacagcgccagcgtgaagggcaggttcaccctgagcagggacgacagccagagcatcctgtacctgcagatgaacgccctgaggcccgaggacagcgccacctactactgcgccagggacgccgcctactacagctactacagccccgagggcgccatggactactggggccagggcaccagcgtgaccgtgagcagcgccagcggcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccctgcccgtgaccgccctgctgctgcccctggccctgctgctgcacgccgccaggcccatggccgactacaaggacatcgtgatgacccagagccacaagttcctgctggtgagcgtgggcgacagggtgagcatcacctgcaaggccagccaggacgtgagcaccgccgtggcctggtaccagcagaagcccggccagagccccaagctgctgatctacagcgccagctacaggtacaccggcgtgcccgacaggttcatcggcagcggcagcggcaccgacttcaccctgaccatcagcagcgtgcaggccgaggacctggccgactacttctgccagcagcactacagcacccccctgaccttcggcgccggcaccaagctggagatcaagaggggcggcggcggcagcggcggcggcggcagcggcggcggcggcagcagcggcggcggcagcgaggtgcagctgaaggagagcggccccggcctggtggcccccagccagagcctgagcatcacctgcaccgtgagcggcttccccctgaccagctacggcgtgagctgggtgaggcagccccccggcaagggcctggagtggctgggcgtgatctggggcgacggcagcaccaactaccacagcgccctgatcagcaggctgagcatcagcaaggacaacagcaagagccaggtgttcctgaagctgaacaacctgcagaccgacgacaccgccacctactactgcgccagggacacctactacccctactacgccatggactactggggccagggcaccagcgtgaccgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaaacggggcagaaagaaactcctgtatatattcaaacaaccatttatgagaccagtacaaactactcaagaggaagatggctgtagctgccgatttccagaagaagaagaaggaggatgtgaactgagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaa

SEQ ID NO: 140 - protein, 763 aa, Artificial Sequence
  (BCMA-A7D-28-4-1BBL, CD269 A7D-28-4-1BBL amino acid sequence)
MALPVTALLLPLALLLHAARPDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKGGGGSGGGGSGGGGSQIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 141 - DNA, 2300 bp, Artificial Sequence
  (BCMA-A7D-28-4-1BBL, CD269 A7D-28-4-1BBL CAR nucleotide sequence)
atggccttaccagtgaccgccttgctcctgccgctggccttgctgctccacgccgccaggccggacgtggtgatgacccagagccacaggttcatgagcaccagcgtgggcgacagggtgagcatcacctgcagggccagccaggacgtgaacaccgccgtgagctggtaccagcagaagcccggccagagccccaagctgctgatcttcagcgccagctacaggtacaccggcgtgcccgacaggttcaccggcagcggcagcggcgccgacttcaccctgaccatcagcagcgtgcaggccgaggacctggccgtgtactactgccagcagcactacagcaccccctggaccttcggcggcggcaccaagctggacatcaagggaggggggggatccgggggaggaggctccggcggaggcggaagccagatccagctggtgcagagcggccccgacctgaagaagcccggcgagaccgtgaagctgagctgcaaggccagcggctacaccttcaccaacttcggcatgaactgggtgaagcaggcccccggcaagggcttcaagtggatggcctggatcaacacctacaccggcgagagctacttcgccgacgacttcaagggcaggttcgccttcagcgtggagaccagcgccaccaccgcctacctgcagatcaacaacctgaagaccgaggacaccgccacctacttctgcgccaggggcgagatctactacggctacgacggcggcttcgcctactggggccagggcaccctggtgaccgtgagcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataagtttaaac

SEQ ID NO: 142 - protein, 821 aa, Artificial Sequence
  (BCMA-A7D-28-IL-15/IL-15sushi anchor, CD269-A7D-28-IL-15/IL-15sushi anchor CAR amino acid sequence)
MALPVTALLLPLALLLHAARPDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKGGGGSGGGGSGGGGSQIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRTTTPAPRPPTPAPTIASQPLSLRPEACRPAAGGAVHTRGLDFACDVAISTSTVLLCGLSAVSLLACY

SEQ ID NO: 143 - DNA, 2474 bp, Artificial Sequence
  (BCMA-A7D-28-IL-15/IL-15sushi anchor, CD269-A7D-28-IL-15/IL-15sushi anchor CAR nucleotide sequence)
atggccttaccagtgaccgccttgctcctgccgctggccttgctgctccacgccgccaggccggacgtggtgatgacccagagccacaggttcatgagcaccagcgtgggcgacagggtgagcatcacctgcagggccagccaggacgtgaacaccgccgtgagctggtaccagcagaagcccggccagagccccaagctgctgatcttcagcgccagctacaggtacaccggcgtgcccgacaggttcaccggcagcggcagcggcgccgacttcaccctgaccatcagcagcgtgcaggccgaggacctggccgtgtactactgccagcagcactacagcaccccctggaccttcggcggcggcaccaagctggacatcaagggaggggggggatccgggggaggaggctccggcggaggcggaagccagatccagctggtgcagagcggccccgacctgaagaagcccggcgagaccgtgaagctgagctgcaaggccagcggctacaccttcaccaacttcggcatgaactgggtgaagcaggcccccggcaagggcttcaagtggatggcctggatcaacacctacaccggcgagagctacttcgccgacgacttcaagggcaggttcgccttcagcgtggagaccagcgccaccaccgcctacctgcagatcaacaacctgaagaccgaggacaccgccacctacttctgcgccaggggcgagatctactacggctacgacggcggcttcgcctactggggccagggcaccctggtgaccgtgagcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcagatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagaaccaccacccccgcccccaggccccccacccccgcccccaccatcgccagccagcccctgagcctgaggcccgaggcctgcaggcccgccgccggcggcgccgtgcacaccaggggcctggacttcgcctgcgacgtggctatctccacgtccactgtcctgctgtgtgggctgagcgctgtgtctctcctggcatgctactaagtttaaac

SEQ ID NO: 144 - protein, 491 aa, Artificial Sequence
  (BAFFR-28-2G CAR amino acid sequence)
MALPVTALLLPLALLLHAARPQVQLQQSGPGLVKPSQTLSLICAISGDSVSSNSAAWGWIRQSPGRGLEWLGRIYYRSKWYNSYAVSVKSRITINPDTSKNQFSLQLNSVTPEDTAVYYCARYDWVPKIGVFDSWGQGTLVTVSSGGGGSGGGGSGGGGSDIVLTQSPATLSLSPGERATLSCRASQFISSSYLSWYQQKPGQAPRLLIYGSSSRATGVPARFSGSGSGTDFTLTISSLEPEDFAVYYCQQLYSSPMTFGQGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 145 - DNA, 1484 bp, Artificial Sequence
  (BAFFR-28-2G CAR nucleotide sequence)
atggccctgcccgtgaccgccctgctgctgcccctggccctgctgctgcacgccgccaggccccaggtgcagctgcagcagagcggcccaggcctggtcaagccctctcagaccctgtcactgatctgcgccatttcaggcgacagcgtgagcagcaacagcgccgcctggggctggatcaggcagagccccggtaggggcctggaatggctgggcaggatctactacaggtccaagtggtacaacagctacgccgtgagcgtgaagagcaggatcaccatcaaccctgacaccagcaagaaccagttctcactgcagctcaacagcgtgacccccgaggacaccgccgtgtactactgcgccagatacgactgggtgcccaagatcggcgtgttcgacagctggggccagggcaccctggtgaccgtgtcaagcggaggggggggatccgggggaggaggctccggcggaggcggaagcgatatcgtgctgacacagagccccgccaccctgagcctgagcccaggcgagagggccaccctgtcctgcagggccagccagtttatcagcagcagctacctgtcctggtatcagcagaagcccggccaggcccctagactgctgatctacggcagctcctctcgggccaccggcgtgcccgccaggttcagcggcagcggctccggcaccgacttcaccctgacaatcagcagcctggagcccgaggacttcgccgtgtactactgccagcagctgtacagctcacccatgaccttcggccagggcaccaaggtggagatcaagaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaggagtaagaggagcaggctcctgcacagtgactacatgaacatgactccccgccgccccgggcccacccgcaagcattaccagccctatgccccaccacgcgacttcgcagcctatcgctccagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 146 - protein, 1024 aa, Artificial Sequence
  (CD4-CD123b-2G CAR amino acid sequence)
MALPVTALLLPLALLLHAARPDIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKGGGGSGGGGSGGGGSQVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPMADYKDIVMTQSHKFMSTSVGDRVNITCKASQNVDSAVAWYQQKPGQSPKALIYSASYRYSGVPDRFTGRGSGTDFTLTISSVQAEDLAVYYCQQYYSTPWTFGGGTKLEIKRGGGGSGGGGSGGGGSGGGGSEVKLVESGGGLVQPGGSLSLSCAASGFTFTDYYMSWVRQPPGKALEWLALIRSKADGYTTEYSASVKGRFTLSRDDSQSILYLQMNALRPEDSATYYCARDAAYYSYYSPEGAMDYWGQGTSVTVSSASGATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 147 - DNA, 3083 bp, Artificial Sequence
  (CD4-CD123b-2G CAR nucleotide sequence)
atggccctgcccgtgaccgccctgctgctgcccctggccctgctgctgcacgccgccaggcccgacatcgtgatgacccaaagccccgacagcctggccgtgagcctgggcgagagggtgaccatgaactgcaaaagcagccagtccctgctgtactccaccaaccagaagaactacctggcttggtatcaacagaagcccggacagagccccaagctgctgatctattgggccagcactagggaaagcggcgtgcccgataggttcagcggcagcgggagcggcacagacttcactctgaccattagcagcgtgcaggctgaggatgtggccgtctactactgccagcagtactacagctacaggacctttgggggcggaactaagctggagatcaagggaggggggggatccgggggaggaggctccggcggaggcggaagccaagtgcaactgcagcagagcggcccagaggtggtcaaacctggggcaagcgtgaagatgagctgcaaggctagcggctataccttcaccagctatgtgatccactgggtgaggcagaaaccaggacagggcctggactggatcggctacatcaacccctacaatgacggcaccgattatgacgaaaaattcaaggggaaggccaccctgaccagcgacaccagcacaagcaccgcctacatggagctgtccagcctgaggtccgaggacaccgccgtgtattactgtgccagggagaaggacaattacgccaccggcgcttggttcgcctactggggccagggcacactggtgacagtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcccccctggccggcacctgcggcgtgctgctgctgagcctggtgatcaccctgtactgcaagaggggcaggaagaagctgctgtacatcttcaagcagcccttcatgaggcccgtgcagaccacccaggaggaggacggctgcagctgcaggttccccgaggaggaggagggcggctgcgagctgagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggggaagcggagctactaacttcagcctgctgaagcaggctggagacgtggaggagaaccctggacctatggccttaccagtgaccgccttgctcctgccgctggccttgctgctccacgccgccaggccgatggccgactacaaggacatcgtgatgacccagagccacaagttcatgagcaccagcgtgggcgacagggtgaacatcacctgcaaggccagccagaacgtggacagcgccgtggcctggtaccagcagaagcccggccagagccccaaggccctgatctacagcgccagctacaggtacagcggcgtgcccgacaggttcaccggcaggggcagcggcaccgacttcaccctgaccatcagcagcgtgcaggccgaggacctggccgtgtactactgccagcagtactacagcaccccctggaccttcggcggcggcaccaagctggagatcaagaggggcggcggcggcagcggcggcggcggcagcggcggcggcggcagcggcggcggcggcagcgaggtgaagctggtggagagcggcggcggcctggtgcagcccggcggcagcctgagcctgagctgcgccgccagcggcttcaccttcaccgactactacatgagctgggtgaggcagccccccggcaaggccctggagtggctggccctgatcaggagcaaggccgacggctacaccaccgagtacagcgccagcgtgaagggcaggttcaccctgagcagggacgacagccagagcatcctgtacctgcagatgaacgccctgaggcccgaggacagcgccacctactactgcgccagggacgccgcctactacagctactacagccccgagggcgccatggactactggggccagggcaccagcgtgaccgtgagcagcgccagcggcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 148 - protein, 782 aa, Artificial Sequence
  (BCMA-A7D-28-IL-15/IL-15sushi, CD269-A7D-28-IL-15/IL-15sushi CAR amino acid sequence)
MALPVTALLLPLALLLHAARPDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKGGGGSGGGGSGGGGSQIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 149 - DNA, 2357 bp, Artificial Sequence
  (BCMA-A7D-28-IL-15/IL-15sushi, CD269-A7D-28-IL-15/IL-15sushi CAR nucleotide sequence)
atggccttaccagtgaccgccttgctcctgccgctggccttgctgctccacgccgccaggccggacgtggtgatgacccagagccacaggttcatgagcaccagcgtgggcgacagggtgagcatcacctgcagggccagccaggacgtgaacaccgccgtgagctggtaccagcagaagcccggccagagccccaagctgctgatcttcagcgccagctacaggtacaccggcgtgcccgacaggttcaccggcagcggcagcggcgccgacttcaccctgaccatcagcagcgtgcaggccgaggacctggccgtgtactactgccagcagcactacagcaccccctggaccttcggcggcggcaccaagctggacatcaagggaggggggggatccgggggaggaggctccggcggaggcggaagccagatccagctggtgcagagcggccccgacctgaagaagcccggcgagaccgtgaagctgagctgcaaggccagcggctacaccttcaccaacttcggcatgaactgggtgaagcaggcccccggcaagggcttcaagtggatggcctggatcaacacctacaccggcgagagctacttcgccgacgacttcaagggcaggttcgccttcagcgtggagaccagcgccaccaccgcctacctgcagatcaacaacctgaagaccgaggacaccgccacctacttctgcgccaggggcgagatctactacggctacgacggcggcttcgcctactggggccagggcaccctggtgaccgtgagcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 150 - protein, 492 aa, Artificial Sequence
  (CLL-1-3233-28-2G CAR amino acid sequence)
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 151 - DNA, 1487 bp, Artificial Sequence
  (CLL-1-3233-28-2G CAR nucleotide sequence)
atggccctgcccgtgaccgccctgctgctgcccctggccctgctgctgcacgccgccaggcccgacatccagatgacccagagccccagcagcctgagcgccagcgtgggcgacagggtgaccatcacctgcagggccagccagagcgtgagcaccagcagctacaactacatgcactggtaccagcagaagcccggcaagccccccaagctgctgatcaagtacgccagcaacctggagagcggcgtgcccagcaggttcagcggcagcggcagcggcaccgacttcaccctgaccatcagcagcctgcagcccgaggacttcgccacctactactgccagcacagctgggagatccccctgaccttcggccagggcaccaaggtggagatcaagggaggggggggatccgggggaggaggctccggcggaggcggaagcgaggtgcagctggtgcagagcggcgccgaggtgaagaagcccggcgccagcgtgaaggtgagctgcaaggccagcggctacagcttcaccgactactacatgcactgggtgaggcaggcccccggccagggcctggagtggatcggcaggatcaacccctacaacggcgccgccttctacagccagaacttcaaggacagggtgaccctgaccgtggacaccagcaccagcaccgcctacctggagctgagcagcctgaggagcgaggacaccgccgtgtactactgcgccatcgagaggggcgccgacctggagggctacgccatggactactggggccagggcaccctggtgaccgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaggagtaagaggagcaggctcctgcacagtgactacatgaacatgactccccgccgccccgggcccacccgcaagcattaccagccctatgccccaccacgcgacttcgcagcctatcgctccagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 152 - protein, 486 aa, Artificial Sequence
  (CLL-1-3738-28-2G CAR amino acid sequence)
MALPVTALLLPLALLLHAARPDIQMTQSHKFMSTSVGDRVSITCKASQDVSTAVAWFQQKPGQSPKLLIYSPSYRYTGVPDRFTGSGSGTDFTFTISSVQAEDLAVYYCQQLYSTPYTFGGGTKLEIKGGGGSGGGGSGGGGSEVQLQQSGPELVKPGASVKMSCKASGYTFTDYYLDWVKQSHGESFEWIGRVNPYNGGTIYNQKFKGKATLTVDKSSSTAYMDLNSLTSEDSAVYYCARDHYRYDPLLDYWGQGTTLTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 153 - DNA, 1469 bp, Artificial Sequence
  (CLL-1-3738-28-2G CAR nucleotide sequence)
atggccctgcccgtgaccgccctgctgctgcccctggccctgctgctgcacgccgccaggcccgacatccagatgacccagagccacaagttcatgagcaccagcgtgggcgacagggtgagcatcacctgcaaggccagccaggacgtgagcaccgccgtggcctggttccagcagaagcccggccagagccccaagctgctgatctacagccccagctacaggtacaccggcgtgcccgacaggttcaccggcagcggcagcggcaccgacttcaccttcaccatcagcagcgtgcaggccgaggacctggccgtgtactactgccagcagctgtacagcaccccctacaccttcggcggcggcaccaagctggagatcaagggaggggggggatccgggggaggaggctccggcggaggcggaagcgaggtgcagctgcagcagagcggccccgagctggtgaagcccggcgccagcgtgaagatgagctgcaaggccagcggctacaccttcaccgactactacctggactgggtgaagcagagccacggcgagagcttcgagtggatcggcagggtgaacccctacaacggcggcaccatctacaaccagaagttcaagggcaaggccaccctgaccgtggacaagagcagcagcaccgcctacatggacctgaacagcctgaccagcgaggacagcgccgtgtactactgcgccagggaccactacaggtacgaccccctgctggactactggggccagggcaccaccctgaccgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaggagtaagaggagcaggctcctgcacagtgactacatgaacatgactccccgccgccccgggcccacccgcaagcattaccagccctatgccccaccacgcgacttcgcagcctatcgctccagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 154 - protein, 1011 aa, Artificial Sequence
  (CLL-1-3233-CD33b-2G CAR amino acid sequence)
MALPVTALLLPLALLLHAARPDIQMTQSPSSLSASVGDRVTITCRASQSVSTSSYNYMHWYQQKPGKPPKLLIKYASNLESGVPSRFSGSGSGTDFTLTISSLQPEDFATYYCQHSWEIPLTFGQGTKVEIKGGGGSGGGGSGGGGSEVQLVQSGAEVKKPGASVKVSCKASGYSFTDYYMHWVRQAPGQGLEWIGRINPYNGAAFYSQNFKDRVTLTVDTSTSTAYLELSSLRSEDTAVYYCAIERGADLEGYAMDYWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPMADYKDIVMTQSHKFLLVSVGDRVSITCKASQDVSTAVAWYQQKPGQSPKLLIYSASYRYTGVPDRFIGSGSGTDFTLTISSVQAEDLADYFCQQHYSTPLTFGAGTKLEIKRGGGGSGGGGSGGGGSSGGGSEVQLKESGPGLVAPSQSLSITCTVSGFPLTSYGVSWVRQPPGKGLEWLGVIWGDGSTNYHSALISRLSISKDNSKSQVFLKLNNLQTDDTATYYCARDTYYPYYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 155 - DNA, 3044 bp, Artificial Sequence
  (CLL-1-3233-CD33b-2G CAR nucleotide sequence)
atggccctgcccgtgaccgccctgctgctgcccctggccctgctgctgcacgccgccaggcccgacatccagatgacccagagccccagcagcctgagcgccagcgtgggcgacagggtgaccatcacctgcagggccagccagagcgtgagcaccagcagctacaactacatgcactggtaccagcagaagcccggcaagccccccaagctgctgatcaagtacgccagcaacctggagagcggcgtgcccagcaggttcagcggcagcggcagcggcaccgacttcaccctgaccatcagcagcctgcagcccgaggacttcgccacctactactgccagcacagctgggagatccccctgaccttcggccagggcaccaaggtggagatcaagggaggggggggatccgggggaggaggctccggcggaggcggaagcgaggtgcagctggtgcagagcggcgccgaggtgaagaagcccggcgccagcgtgaaggtgagctgcaaggccagcggctacagcttcaccgactactacatgcactgggtgaggcaggcccccggccagggcctggagtggatcggcaggatcaacccctacaacggcgccgccttctacagccagaacttcaaggacagggtgaccctgaccgtggacaccagcaccagcaccgcctacctggagctgagcagcctgaggagcgaggacaccgccgtgtactactgcgccatcgagaggggcgccgacctggagggctacgccatggactactggggccagggcaccctggtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcccccctggccggcacctgcggcgtgctgctgctgagcctggtgatcaccctgtactgcaggagtaagaggagcaggctcctgcacagtgactacatgaacatgactccccgccgccccgggcccacccgcaagcattaccagccctatgccccaccacgcgacttcgcagcctatcgctccagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggggaagcggagccaccaacttcagcctgctgaagcaggccggcgacgtggaggagaaccccggccccatggccctgcccgtgaccgccctgctgctgcccctggccctgctgctgcacgccgccaggcccatggccgactacaaggacatcgtgatgacccagagccacaagttcctgctggtgagcgtgggcgacagggtgagcatcacctgcaaggccagccaggacgtgagcaccgccgtggcctggtaccagcagaagcccggccagagccccaagctgctgatctacagcgccagctacaggtacaccggcgtgcccgacaggttcatcggcagcggcagcggcaccgacttcaccctgaccatcagcagcgtgcaggccgaggacctggccgactacttctgccagcagcactacagcacccccctgaccttcggcgccggcaccaagctggagatcaagaggggcggcggcggcagcggcggcggcggcagcggcggcggcggcagcagcggcggcggcagcgaggtgcagctgaaggagagcggccccggcctggtggcccccagccagagcctgagcatcacctgcaccgtgagcggcttccccctgaccagctacggcgtgagctgggtgaggcagccccccggcaagggcctggagtggctgggcgtgatctggggcgacggcagcaccaactaccacagcgccctgatcagcaggctgagcatcagcaaggacaacagcaagagccaggtgttcctgaagctgaacaacctgcagaccgacgacaccgccacctactactgcgccagggacacctactacccctactacgccatggactactggggccagggcaccagcgtgaccgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaaacggggcagaaagaaactcctgtatatattcaaacaaccatttatgagaccagtacaaactactcaagaggaagatggctgtagctgccgatttccagaagaagaagaaggaggatgtgaactgagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 156 - protein, 1011 aa, Artificial Sequence; identical to SEQ ID NO: 154
  (CLL-1-3738-CD33b-2G CAR amino acid sequence)

SEQ ID NO: 157 - DNA, 2999 bp, Artificial Sequence
  (CLL-1-3738-CD33b-2G CAR nucleotide sequence)
agtgaccgccttgctcctgccgctggccttgctgctccacgccgccaggccgcagatcgtgctgacccagagccccgccatcatgagcgccagccccggcgagaaggtgaccatcacctgcagcgccagcagcagcatcagctacatgcactggttccagcagaagcccggcaccagccccaagctgtggatctacaccaccagcaacctggccagcggcgtgcccgccagattcagcggcagcggcagcggcaccagctacagcctgaccatcagcagaatggaggccgaggacgccgccacctactactgccaccagagaagcacctaccccctgaccttcggcagcggcaccaagctggagctgaagggaggggggggatccgggggaggaggctccggcggaggcggaagccaggtgcagctgcagcagagcggcgccgagctggccaagcccggcgccagcgtgaagatgagctgcaaggccagcggctacaccttcaccagctacagaatgcactgggtgaagcagagacccggccagggcctggagtggatcggctacatcaaccccagcaccggctacaccgagtacaaccagaagttcaaggacaaggccaccctgaccgccgacaagagcagcagcaccgcctacatgcagctgagcagcctgaccttcgaggacagcgccgtgtactactgcgccagaggcggcggcgtgttcgactactggggccagggcaccaccctgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccctgcccgtgaccgccctgctgctgcccctggccctgctgctgcacgccgccaggcccatggccgactacaaggacatcgtgatgacccagagccacaagttcctgctggtgagcgtgggcgacagggtgagcatcacctgcaaggccagccaggacgtgagcaccgccgtggcctggtaccagcagaagcccggccagagccccaagctgctgatctacagcgccagctacaggtacaccggcgtgcccgacaggttcatcggcagcggcagcggcaccgacttcaccctgaccatcagcagcgtgcaggccgaggacctggccgactacttctgccagcagcactacagcacccccctgaccttcggcgccggcaccaagctggagatcaagaggggcggcggcggcagcggcggcggcggcagcggcggcggcggcagcagcggcggcggcagcgaggtgcagctgaaggagagcggccccggcctggtggcccccagccagagcctgagcatcacctgcaccgtgagcggcttccccctgaccagctacggcgtgagctgggtgaggcagccccccggcaagggcctggagtggctgggcgtgatctggggcgacggcagcaccaactaccacagcgccctgatcagcaggctgagcatcagcaaggacaacagcaagagccaggtgttcctgaagctgaacaacctgcagaccgacgacaccgccacctactactgcgccagggacacctactacccctactacgccatggactactggggccagggcaccagcgtgaccgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaaacggggcagaaagaaactcctgtatatattcaaacaaccatttatgagaccagtacaaactactcaagaggaagatggctgtagctgccgatttccagaagaagaagaaggaggatgtgaactgagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 158 - protein, 78 aa, Artificial Sequence
  (extracellular domain of BAFF-receptor amino acid sequence)
MRRGPRSLRGRDAPAPTPCVPAECFDLLVRHCVACGLLRTPRPKPAGASSPAPRTALQPQESVGAGAGEAALPLPGLL

SEQ ID NO: 159 - DNA, 2663 bp, Artificial Sequence
  (L8-CD7-28-52 -IL-15/IL-15sushi CAR nucleotide sequence)
atggccttaccagtgaccgccttgctcctgccgctggccttgctgctccacgccgccaggccgggcgcccagcccgccatggccgcctacaaggacatccagatgacccagaccaccagcagcctgagcgccagcctgggcgacagagtgaccatcagctgcagcgccagccagggcatcagcaactacctgaactggtaccagcagaagcccgacggcaccaacaagctgctgatctactacaccagcagcctgcacagcggcgtgcccagcagattcagcggcagcggcagcggcaccgactacagcctgcacagcaacctggagcccgaggacatcgccacctactactgccagcagtacagcaagctgccctacaccttcggcggcggcaccaagctggagatcaagagaggcggcggcggcagcggcggcggcggcagcggcggcggcggcagcggcggcggcggcagcgaggtgcagctggtggagagcggcggcggcctggtgaagcccggcggcagcctgaagctgagctgcgccgccagcggcctgaccttcagcagctacgccatgagctggaacagacagacccccgagaagagactggagtgggtggccagcatcagcagcggcggcttcacctactaccccgacagcaacaagggcagattcaccatcagcagagacaacgccagaaacatcctgtacctgcagatgagcagcctgagaagcgaggacaccgccatgtactactgcgccagagacgaggtgagaggctacctggacgtgtggggcgccggcaccaccgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatggccctgcccgtgaccgccctgctgctgcccctggccctgctgctgcacgccgccaggcccggccagaacgacaccagccagaccagcagccccagcagcccgctgtttccgggcccgagcaaaccgttttgggtgctggtggtggtgggcggcgtgctggcgtgctatagcctgctggtgaccgtggcgtttattattttttgggtgggaagcggagctactaacttgagcctgctgaagcaggctggagacgtggaggagaaccctggacctatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 160 - protein, 884 aa, Artificial Sequence
  (L8-CD7-28-52 -IL-15/IL-15sushi CAR amino acid sequence)
MALPVTALLLPLALLLHAARPGAQPAMAAYKDIQMTQTTSSLSASLGDRVTISCSASQGISNYLNWYQQKPDGTNKLLIYYTSSLHSGVPSRFSGSGSGTDYSLHSNLEPEDIATYYCQQYSKLPYTFGGGTKLEIKRGGGGSGGGGSGGGGSGGGGSEVQLVESGGGLVKPGGSLKLSCAASGLTFSSYAMSWNRQTPEKRLEWVASISSGGFTYYPDSNKGRFTISRDNARNILYLQMSSLRSEDTAMYYCARDEVRGYLDVWGAGTTVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPGQNDTSQTSSPSSPLFPGPSKPFWVLVVVGGVLACYSLLVTVAFIIFWVGSGATNLSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 161 - protein, 201 aa, Artificial Sequence [sequence omitted]

SEQ ID NO: 162 - protein, 793 aa, Artificial Sequence
  (L8-CD7-28-IL-15/IL-15sushi CAR amino acid sequence)
MALPVTALLLPLALLLHAARPGAQPAMAAYKDIQMTQTTSSLSASLGDRVTISCSASQGISNYLNWYQQKPDGTNKLLIYYTSSLHSGVPSRFSGSGSGTDYSLHSNLEPEDIATYYCQQYSKLPYTFGGGTKLEIKRGGGGSGGGGSGGGGSGGGGSEVQLVESGGGLVKPGGSLKLSCAASGLTFSSYAMSWNRQTPEKRLEWVASISSGGFTYYPDSNKGRFTISRDNARNILYLQMSSLRSEDTAMYYCARDEVRGYLDVWGAGTTVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNLSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 163 - DNA, 2398 bp, Artificial Sequence
  (L8-CD7-28-IL-15/IL-15sushi CAR nucleotide sequence)
gcgatcgcatggccttaccagtgaccgccttgctcctgccgctggccttgctgctccacgccgccaggccgggcgcccagcccgccatggccgcctacaaggacatccagatgacccagaccaccagcagcctgagcgccagcctgggcgacagagtgaccatcagctgcagcgccagccagggcatcagcaactacctgaactggtaccagcagaagcccgacggcaccaacaagctgctgatctactacaccagcagcctgcacagcggcgtgcccagcagattcagcggcagcggcagcggcaccgactacagcctgcacagcaacctggagcccgaggacatcgccacctactactgccagcagtacagcaagctgccctacaccttcggcggcggcaccaagctggagatcaagagaggcggcggcggcagcggcggcggcggcagcggcggcggcggcagcggcggcggcggcagcgaggtgcagctggtggagagcggcggcggcctggtgaagcccggcggcagcctgaagctgagctgcgccgccagcggcctgaccttcagcagctacgccatgagctggaacagacagacccccgagaagagactggagtgggtggccagcatcagcagcggcggcttcacctactaccccgacagcaacaagggcagattcaccatcagcagagacaacgccagaaacatcctgtacctgcagatgagcagcctgagaagcgaggacaccgccatgtactactgcgccagagacgaggtgagaggctacctggacgtgtggggcgccggcaccaccgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagctactaacttgagcctgctgaagcaggctggagacgtggaggagaaccctggacctatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 164 - protein, 767 aa, Artificial Sequence
  (CD19b-28-4-1BBL CAR amino acid sequence)
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPRGSGEGRGSLLTCGDVEENPGPMEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 165 - DNA, 2320 bp, Artificial Sequence
  (CD19b-28-4-1BBL CAR nucleotide sequence)
gcgatcgcatggccttaccagtgaccgccttgctcctgccgctggccttgctgctccacgccgccaggccggaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataagtttaaac

SEQ ID NO: 166 - protein, 1001 aa, Artificial Sequence
  (CD19b-CD22b-28 amino acid sequence)
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPQVQLQESGAELSKPGASVKMSCKASGYTFTSYWLHWIKQRPGQGLEWIGYINPRNDYTEYNQNFKDKATLTADKSSSTAYMQLSSLTSEDSAVYYCARRDITTFYWGQGTTLTVSSGGGGSGGGGSGGGGSDIQLTQSPSSLAVSAGENVTMSCKSSQSVLYSANHKNYLAWYQQKPGQSPKLLIYWASTRESGVPDRFTGSGTDFTLTISRVQVEDLAIYYCHQYLSSWTFGGGTKLEIKRTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 167 - DNA, 3014 bp, Artificial Sequence
  (CD19b-CD22b-28 CAR nucleotide sequence)
atggccttaccagtgaccgccttgctcctgccgctggccttgctgctccacgccgccaggccggaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccctgcccgtgaccgccctgctgctgcccctggccctgctgctgcacgccgccaggccccaggtgcagctgcaggagagcggcgccgagctgagcaagcccggcgccagcgtgaagatgagctgcaaggccagcggctacaccttcaccagctactggctgcactggatcaagcagaggcccggccagggcctggagtggatcggctacatcaaccccaggaacgactacaccgagtacaaccagaacttcaaggacaaggccaccctgaccgccgacaagagcagcagcaccgcctacatgcagctgagcagcctgaccagcgaggacagcgccgtgtactactgcgccaggagggacatcaccaccttctactggggccagggcaccaccctgaccgtgagcagcggaggggggggatccgggggaggaggctccggcggaggcggaagcgacatccagctgacccagagccccagcagcctggccgtgagcgccggcgagaacgtgaccatgagctgcaagagcagccagagcgtgctgtacagcgccaaccacaagaactacctggcctggtaccagcagaagcccggccagagccccaagctgctgatctactgggccagcaccagggagagcggcgtgcccgacaggttcaccggcagcggcaccgacttcaccctgaccatcagcagggtgcaggtggaggacctggccatctactactgccaccagtacctgagcagctggaccttcggcggcggcaccaagctggagatcaagaggaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaggagtaagaggagcaggctcctgcacagtgactacatgaacatgactccccgccgccccgggcccacccgcaagcattaccagccctatgccccaccacgcgacttcgcagcctatcgctccagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagcccaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 168 - protein, 379 aa, Artificial Sequence
  (FcER1A-28-2G CAR amino acid sequence)
MALPVTALLLPLALLLHAARPVPQKPKVSLNPPWNRIFKGENVTLTCNGNNFFEVSSTKWFHNGSLSEETNSSLNIVNAKFEDSGEYKCQHQQVNESEPVYLEVFSDWLLLQASAEVVMEGQPLFLRCHGWRNWDVYKVIYYKDGEALKYWYENHNISITNATVEDSGTYYCTGKVWQLDYESEPLNITVIKAPREKYWLQIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 169 - DNA, 1148 bp, Artificial Sequence
  (FcER1A-28-2G CAR nucleotide sequence)
atggccttaccagtgaccgccttgctcctgccgctggccttgctgctccacgccgccaggccggtgccccagaagcccaaggtgagcctgaaccccccctggaacaggatcttcaagggcgagaacgtgaccctgacctgcaacggcaacaacttcttcgaggtgagcagcaccaagtggttccacaacggcagcctgagcgaggagaccaacagcagcctgaacatcgtgaacgccaagttcgaggacagcggcgagtacaagtgccagcaccagcaggtgaacgagagcgagcccgtgtacctggaggtgttcagcgactggctgctgctgcaggccagcgccgaggtggtgatggagggccagcccctgttcctgaggtgccacggctggaggaactgggacgtgtacaaggtgatctactacaaggacggcgaggccctgaagtactggtacgagaaccacaacatcagcatcaccaacgccaccgtggaggacagcggcacctactactgcaccggcaaggtgtggcagctggactacgagagcgagcccctgaacatcaccgtgatcaaggcccccagggagaagtactggctgcagatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 170 - protein, 654 aa, Artificial Sequence
  (FcER1A-28-4-1BBL CAR amino acid sequence)
MALPVTALLLPLALLLHAARPVPQKPKVSLNPPWNRIFKGENVTLTCNGNNFFEVSSTKWFHNGSLSEETNSSLNIVNAKFEDSGEYKCQHQQVNESEPVYLEVFSDWLLLQASAEVVMEGQPLFLRCHGWRNWDVYKVIYYKDGEALKYWYENHNISITNATVEDSGTYYCTGKVWQLDYESEPLNITVIKAPREKYWLQIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 171 - DNA, 1973 bp, Artificial Sequence
  (FcER1A-28-4-1BBL CAR nucleotide sequence)
atggccttaccagtgaccgccttgctcctgccgctggccttgctgctccacgccgccaggccggtgccccagaagcccaaggtgagcctgaaccccccctggaacaggatcttcaagggcgagaacgtgaccctgacctgcaacggcaacaacttcttcgaggtgagcagcaccaagtggttccacaacggcagcctgagcgaggagaccaacagcagcctgaacatcgtgaacgccaagttcgaggacagcggcgagtacaagtgccagcaccagcaggtgaacgagagcgagcccgtgtacctggaggtgttcagcgactggctgctgctgcaggccagcgccgaggtggtgatggagggccagcccctgttcctgaggtgccacggctggaggaactgggacgtgtacaaggtgatctactacaaggacggcgaggccctgaagtactggtacgagaaccacaacatcagcatcaccaacgccaccgtggaggacagcggcacctactactgcaccggcaaggtgtggcagctggactacgagagcgagcccctgaacatcaccgtgatcaaggcccccagggagaagtactggctgcagatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataagtttaaac

SEQ ID NO: 172 - protein, 1007 aa, Artificial Sequence
  (CD19b-BAFFR sequence CAR amino acid sequence)
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPQVQLQQSGPGLVKPSQTLSLICAISGDSVSSNSAAWGWIRQSPGRGLEWLGRIYYRSKWYNSYAVSVKSRITINPDTSKNQFSLQLNSVTPEDTAVYYCARYDWVPKIGVFDSWGQGTLVTVSSGGGGSGGGGSGGGGSDIVLTQSPATLSLSPGERATLSCRASQFISSSYLSWYQQKPGQAPRLLIYGSSSRATGVPARFSGSGSGTDFTLTISSLEPEDFAVYYCQQLYSSPMTFGQGTKVEIKTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 173 - DNA, 3040 bp, Artificial Sequence
  (CD19b-BAFFR CAR nucleotide sequence)
gcgatcgcatggccttaccagtgaccgccttgctcctgccgctggccttgctgctccacgccgccaggccggaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccctgcccgtgaccgccctgctgctgcccctggccctgctgctgcacgccgccaggccccaggtgcagctgcagcagagcggcccaggcctggtcaagccctctcagaccctgtcactgatctgcgccatttcaggcgacagcgtgagcagcaacagcgccgcctggggctggatcaggcagagccccggtaggggcctggaatggctgggcaggatctactacaggtccaagtggtacaacagctacgccgtgagcgtgaagagcaggatcaccatcaaccctgacaccagcaagaaccagttctcactgcagctcaacagcgtgacccccgaggacaccgccgtgtactactgcgccagatacgactgggtgcccaagatcggcgtgttcgacagctggggccagggcaccctggtgaccgtgtcaagcggaggggggggatccgggggaggaggctccggcggaggcggaagcgatatcgtgctgacacagagccccgccaccctgagcctgagcccaggcgagagggccaccctgtcctgcagggccagccagtttatcagcagcagctacctgtcctggtatcagcagaagcccggccaggcccctagactgctgatctacggcagctcctctcgggccaccggcgtgcccgccaggttcagcggcagcggctccggcaccgacttcaccctgacaatcagcagcctggagcccgaggacttcgccgtgtactactgccagcagctgtacagctcacccatgaccttcggccagggcaccaaggtggagatcaagaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaggagtaagaggagcaggctcctgcacagtgactacatgaacatgactccccgccgccccgggcccacccgcaagcattaccagccctatgccccaccacgcgacttcgcagcctatcgctccagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 174 - protein, 789 aa, Artificial Sequence; identical to SEQ ID NO: 60
  (CD19b-BB-IL-15/IL-15sushi CAR amino acid sequence)

SEQ ID NO: 175 - DNA, 2378 bp, Artificial Sequence
  (CD19b-BB-IL-15/IL-15sushi CAR nucleotide sequence)
atggccttaccagtgaccgccttgctcctgccgctggccttgctgctccacgccgccaggccggaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 176 - protein, 488 aa, Artificial Sequence
  (BCMA-A7D-28-2G, CD269-A7D-28-2G CAR amino acid sequence)
MALPVTALLLPLALLLHAARPDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKGGGGSGGGGSGGGGSQIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 177 - DNA, 1475 bp, Artificial Sequence
  (BCMA-A7D-28-2G, CD269-A7D-28-2G CAR nucleotide sequence)
atggccttaccagtgaccgccttgctcctgccgctggccttgctgctccacgccgccaggccggacgtggtgatgacccagagccacaggttcatgagcaccagcgtgggcgacagggtgagcatcacctgcagggccagccaggacgtgaacaccgccgtgagctggtaccagcagaagcccggccagagccccaagctgctgatcttcagcgccagctacaggtacaccggcgtgcccgacaggttcaccggcagcggcagcggcgccgacttcaccctgaccatcagcagcgtgcaggccgaggacctggccgtgtactactgccagcagcactacagcaccccctggaccttcggcggcggcaccaagctggacatcaagggaggggggggatccgggggaggaggctccggcggaggcggaagccagatccagctggtgcagagcggccccgacctgaagaagcccggcgagaccgtgaagctgagctgcaaggccagcggctacaccttcaccaacttcggcatgaactgggtgaagcaggcccccggcaagggcttcaagtggatggcctggatcaacacctacaccggcgagagctacttcgccgacgacttcaagggcaggttcgccttcagcgtggagaccagcgccaccaccgcctacctgcagatcaacaacctgaagaccgaggacaccgccacctacttctgcgccaggggcgagatctactacggctacgacggcggcttcgcctactggggccagggcaccctggtgaccgtgagcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 178 - protein, 487 aa, Artificial Sequence
  (BCMA-C11D-28, CD269-C11D-28 CAR amino acid sequence)
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 179 - DNA, 1397 bp, Artificial Sequence
  (BCMA-C11D-28, CD269-C11D-28 CAR nucleotide sequence)
atggccttaccagtgaccgccttgctcctgccgctggccttgctgctccacgccgccaggccggacatcgtgctgacccagagcccccccagcctggccatgagcctgggcaagagggccaccatcagctgcagggccagcgagagcgtgaccatcctgggcagccacctgatccactggtaccagcagaagcccggccagccccccaccctgctgatccagctggccagcaacgtgcagaccggcgtgcccgccaggttcagcggcagcggcagcaggaccgacttcaccctgaccatcgaccccgtggaggaggacgacgtggccgtgtactactgcctgcagagcaggaccatccccaggaccttcggcggcggcaccaagctggagatcaagggaggggggggatccgggggaggaggctccggcggaggcggaagccagatccagctggtgcagagcggccccgagctgaagaagcccggcgagaccgtgaagatcagctgcaaggccagcggctacaccttcaccgactacagcatcaactgggtgaagagggcccccggcaagggcctgaagtggatgggctggatcaacaccgagaccagggagcccgcctacgcctacgacttcaggggcaggttcgccttcagcctggagaccagcgccagcaccgcctacctgcagatcaacaacctgaagtacgaggacaccgccacctacttctgcgccctggactacagctacgccatggactactggggccagggcaccagcgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttacca

SEQ ID NO: 180 - protein, 484 aa, Artificial Sequence
  (CS1-hu63-28-2G CAR amino acid sequence)
MALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFFSRYWMSWVRQAPGKGLEWIGEINPDSSTINYAPSLKDKFIISRDNAKNSLYLQMNSLRAEDTAVYYCARPDGNYWYFDVWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 181 - DNA, 1463 bp, Artificial Sequence
  (CS1-hu63-28-2G CAR nucleotide sequence)
atggccttaccagtgaccgccttgctcctgccgctggccttgctgctccacgccgccaggccggacatccagatgacccagagccccagcagcctgagcgccagcgtgggcgacagggtgaccatcacctgcaaggccagccaggacgtgggcatcgccgtggcctggtaccagcagaagcccggcaaggtgcccaagctgctgatctactgggccagcaccaggcacaccggcgtgcccgacaggttcagcggcagcggcagcggcaccgacttcaccctgaccatcagcagcctgcagcccgaggacgtggccacctactactgccagcagtacagcagctacccctacaccttcggccagggcaccaaggtggagatcaagggaggggggggatccgggggaggaggctccggcggaggcggaagcgaggtgcagctggtggagagcggcggcggcctggtgcagcccggcggcagcctgaggctgagctgcgccgccagcggcttcttcagcaggtactggatgagctgggtgaggcaggcccccggcaagggcctggagtggatcggcgagatcaaccccgacagcagcaccatcaactacgcccccagcctgaaggacaagttcatcatcagcagggacaacgccaagaacagcctgtacctgcagatgaacagcctgagggccgaggacaccgccgtgtactactgcgccaggcccgacggcaactactggtacttcgacgtgtggggccagggcaccctggtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 182 - protein, 487 aa, Artificial Sequence
  (CS1-mu34-28-2G CAR amino acid sequence)
MALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 183 - DNA, 1471 bp, Artificial Sequence
  (CS1-mu34-28-2G CAR nucleotide sequence)
tggccttaccagtgaccgccttgctcctgccgctggccttgctgctccacgccgccaggccggacatccagatgacccagagcagcagctacctgagcgtgagcctgggcggcagggtgaccatcacctgcaaggccagcgaccacatcaacaactggctggcctggtaccagcagaagcccggcaacgcccccaggctgctgatcagcggcgccaccagcctggagaccggcgtgcccagcaggttcagcggcagcggcagcggcaaggactacaccctgagcatcaccagcctgcagaccgaggacgtggccacctactactgccagcagtactggagcaccccctggaccttcggcggcggcaccaagctggagatcaagggaggggggggatccgggggaggaggctccggcggaggcggaagccaggtgcagctgcagcagagcggcgccgagctggccaggcccggcgccagcgtgaagctgagctgcaaggccagcggctacaccttcaccagctactggatgcagtgggtgaagcagaggcccggccagggcctggagtggatcggcgccatctaccccggcgacggcgacaccaggtacacccagaagttcaagggcaaggccaccctgaccgccgacaagagcagcagcaccgcctacatgcagctgagcagcctggccagcgaggacagcgccgtgtactactgcgccaggggcaaggtgtactacggcagcaaccccttcgcctactggggccagggcaccctggtgaccgtgagcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 184 - protein, 485 aa, Artificial Sequence
  (CS1-mu90-28-2G CAR amino acid sequence)
MALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNKFKDKATLTVDKSSSTAYMQLSSPTSEDSAVYYCARSTMIATRAMDYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 185 - DNA, 1466 bp, Artificial Sequence
  (CS1-mu90-28-2G CAR nucleotide sequence)
atggccttaccagtgaccgccttgctcctgccgctggccttgctgctccacgccgccaggccggacatcgtgatgacccagagccagaagagcatgagcaccagcgtgggcgacagggtgagcatcacctgcaaggccagccaggacgtgatcaccggcgtggcctggtaccagcagaagcccggccagagccccaagctgctgatctacagcgccagctacaggtacaccggcgtgcccgacaggttcaccggcagcggcagcggcaccgacttcaccttcaccatcagcaacgtgcaggccgaggacctggccgtgtactactgccagcagcactacagcacccccctgaccttcggcgccggcaccaagctggagctgaagggaggggggggatccgggggaggaggctccggcggaggcggaagccaggtgcagctgcagcagcccggcgccgagctggtgaggcccggcgccagcgtgaagctgagctgcaaggccagcggctacagcttcaccacctactggatgaactgggtgaagcagaggcccggccagggcctggagtggatcggcatgatccaccccagcgacagcgagaccaggctgaacaagttcaaggacaaggccaccctgaccgtggacaagagcagcagcaccgcctacatgcagctgagcagccccaccagcgaggacagcgccgtgtactactgcgccaggagcaccatgatcgccaccagggccatggactactggggccagggcaccagcgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 186 - protein, 772 aa, Artificial Sequence
  (CD33b-28-4-1BBL CAR amino acid sequence)
MALPVTALLLPLALLLHAARPMADYKDIVMTQSHKFLLVSVGDRVSITCKASQDVSTAVAWYQQKPGQSPKLLIYSASYRYTGVPDRFIGSGSGTDFTLTISSVQAEDLADYFCQQHYSTPLTFGAGTKLEIKRGGGGSGGGGSGGGGSSGGGSEVQLKESGPGLVAPSQSLSITCTVSGFPLTSYGVSWVRQPPGKGLEWLGVIWGDGSTNYHSALISRLSISKDNSKSQVFLKLNNLQTDDTATYYCARDTYYPYYAMDYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 187 - DNA, 2327 bp, Artificial Sequence
  (CD33b-28-4-1BBL CAR nucleotide sequence)
atggccctgcccgtgaccgccctgctgctgcccctggccctgctgctgcacgccgccaggcccatggccgactacaaggacatcgtgatgacccagagccacaagttcctgctggtgagcgtgggcgacagggtgagcatcacctgcaaggccagccaggacgtgagcaccgccgtggcctggtaccagcagaagcccggccagagccccaagctgctgatctacagcgccagctacaggtacaccggcgtgcccgacaggttcatcggcagcggcagcggcaccgacttcaccctgaccatcagcagcgtgcaggccgaggacctggccgactacttctgccagcagcactacagcacccccctgaccttcggcgccggcaccaagctggagatcaagaggggcggcggcggcagcggcggcggcggcagcggcggcggcggcagcagcggcggcggcagcgaggtgcagctgaaggagagcggccccggcctggtggcccccagccagagcctgagcatcacctgcaccgtgagcggcttccccctgaccagctacggcgtgagctgggtgaggcagccccccggcaagggcctggagtggctgggcgtgatctggggcgacggcagcaccaactaccacagcgccctgatcagcaggctgagcatcagcaaggacaacagcaagagccaggtgttcctgaagctgaacaacctgcagaccgacgacaccgccacctactactgcgccagggacacctactacccctactacgccatggactactggggccagggcaccagcgtgaccgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaggagtaagaggagcaggctcctgcacagtgactacatgaacatgactccccgccgccccgggcccacccgcaagcattaccagccctatgccccaccacgcgacttcgcagcctatcgctccagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggggaagcggagccaccaacttcagcctgctgaagcaggccggcgacgtggaggagaaccccggccccatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataagtttaaac

SEQ ID NO: 188 - protein, 792 aa, Artificial Sequence
  (CD33b-BB-IL-15/IL-15sushi CAR amino acid sequence)
MALPVTALLLPLALLLHAARPMADYKDIVMTQSHKFLLVSVGDRVSITCKASQDVSTAVAWYQQKPGQSPKLLIYSASYRYTGVPDRFIGSGSGTDFTLTISSVQAEDLADYFCQQHYSTPLTFGAGTKLEIKRGGGGSGGGGSGGGGSSGGGSEVQLKESGPGLVAPSQSLSITCTVSGFPLTSYGVSWVRQPPGKGLEWLGVIWGDGSTNYHSALISRLSISKDNSKSQVFLKLNNLQTDDTATYYCARDTYYPYYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 189 - DNA, 2387 bp, Artificial Sequence
  (CD33b-BB-IL-15/IL-15sushi CAR nucleotide sequence)
atggccctgcccgtgaccgccctgctgctgcccctggccctgctgctgcacgccgccaggcccatggccgactacaaggacatcgtgatgacccagagccacaagttcctgctggtgagcgtgggcgacagggtgagcatcacctgcaaggccagccaggacgtgagcaccgccgtggcctggtaccagcagaagcccggccagagccccaagctgctgatctacagcgccagctacaggtacaccggcgtgcccgacaggttcatcggcagcggcagcggcaccgacttcaccctgaccatcagcagcgtgcaggccgaggacctggccgactacttctgccagcagcactacagcacccccctgaccttcggcgccggcaccaagctggagatcaagaggggcggcggcggcagcggcggcggcggcagcggcggcggcggcagcagcggcggcggcagcgaggtgcagctgaaggagagcggccccggcctggtggcccccagccagagcctgagcatcacctgcaccgtgagcggcttccccctgaccagctacggcgtgagctgggtgaggcagccccccggcaagggcctggagtggctgggcgtgatctggggcgacggcagcaccaactaccacagcgccctgatcagcaggctgagcatcagcaaggacaacagcaagagccaggtgttcctgaagctgaacaacctgcagaccgacgacaccgccacctactactgcgccagggacacctactacccctactacgccatggactactggggccagggcaccagcgtgaccgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaaacggggcagaaagaaactcctgtatatattcaaacaaccatttatgagaccagtacaaactactcaagaggaagatggctgtagctgccgatttccagaagaagaagaaggaggatgtgaactgagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 190 - protein, 829 aa, Artificial Sequence
  (CD33b-28-IL-15/IL-15 anchor CAR amino acid sequence)
MALPVTALLLPLALLLHAARPMADYKDIVMTQSHKFLLVSVGDRVSITCKASQDVSTAVAWYQQKPGQSPKLLIYSASYRYTGVPDRFIGSGSGTDFTLTISSVQAEDLADYFCQQHYSTPLTFGAGTKLEIKRGGGGSGGGGSGGGGSSGGGSEVQLKESGPGLVAPSQSLSITCTVSGFPLTSYGVSWVRQPPGKGLEWLGVIWGDGSTNYHSALISRLSISKDNSKSQVFLKLNNLQTDDTATYYCARDTYYPYYAMDYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRTTTPAPRPPTPAPTIASQPLSLRPEACRPAAGGAVHTRGLDFACDVAISTSTVLLCGLSAVSLLACY

SEQ ID NO: 191 - DNA, 2498 bp, Artificial Sequence
  (CD33b-28-IL-15/IL-15 anchor CAR nucleotide sequence)
atggccctgcccgtgaccgccctgctgctgcccctggccctgctgctgcacgccgccaggcccatggccgactacaaggacatcgtgatgacccagagccacaagttcctgctggtgagcgtgggcgacagggtgagcatcacctgcaaggccagccaggacgtgagcaccgccgtggcctggtaccagcagaagcccggccagagccccaagctgctgatctacagcgccagctacaggtacaccggcgtgcccgacaggttcatcggcagcggcagcggcaccgacttcaccctgaccatcagcagcgtgcaggccgaggacctggccgactacttctgccagcagcactacagcacccccctgaccttcggcgccggcaccaagctggagatcaagaggggcggcggcggcagcggcggcggcggcagcggcggcggcggcagcagcggcggcggcagcgaggtgcagctgaaggagagcggccccggcctggtggcccccagccagagcctgagcatcacctgcaccgtgagcggcttccccctgaccagctacggcgtgagctgggtgaggcagccccccggcaagggcctggagtggctgggcgtgatctggggcgacggcagcaccaactaccacagcgccctgatcagcaggctgagcatcagcaaggacaacagcaagagccaggtgttcctgaagctgaacaacctgcagaccgacgacaccgccacctactactgcgccagggacacctactacccctactacgccatggactactggggccagggcaccagcgtgaccgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaggagtaagaggagcaggctcctgcacagtgactacatgaacatgactccccgccgccccgggcccacccgcaagcattaccagccctatgccccaccacgcgacttcgcagcctatcgctccagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcagatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagaaccaccacccccgcccccaggccccccacccccgcccccaccatcgccagccagcccctgagcctgaggcccgaggcctgcaggcccgccgccggcggcgccgtgcacaccaggggcctggacttcgcctgcgacgtggctatctccacgtccactgtcctgctgtgtgggctgagcgctgtgtctctcctggcatgctactaagtttaaac

SEQ ID NO: 192 - protein, 827 aa, Artificial Sequence
  (CD19b-BB-IL-15/IL-15sushi anchor CAR amino acid sequence)
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRTTTPAPRPPTPAPTIASQPLSLRPEACRPAAGGAVHTRGLDFACDVAISTSTVLLCGLSAVSLLACY

SEQ ID NO: 193 - DNA, 2492 bp, Artificial Sequence
  (CD19b-BB-IL-15/IL-15sushi anchor CAR nucleotide sequence)
atggccttaccagtgaccgccttgctcctgccgctggccttgctgctccacgccgccaggccggaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcagatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagaaccaccacccccgcccccaggccccccacccccgcccccaccatcgccagccagcccctgagcctgaggcccgaggcctgcaggcccgccgccggcggcgccgtgcacaccaggggcctggacttcgcctgcgacgtggctatctccacgtccactgtcctgctgtgtgggctgagcgctgtgtctctcctggcatgctactaagtttaaac

SEQ ID NO: 194 - protein, 201 aa, Artificial Sequence [sequence omitted]

SEQ ID NO: 195 - protein, 994 aa, Artificial Sequence
  (BCMA-A7D-CS1-hu63-2G, CD269-A7D-CS1-hu63-2G CD269-A7D-28-2G CAR amino acid sequence)
MALPVTALLLPLALLLHAARPDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKGGGGSGGGGSGGGGSQIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFFSRYWMSWVRQAPGKGLEWIGEINPDSSTINYAPSLKDKFIISRDNAKNSLYLQMNSLRAEDTAVYYCARPDGNYWYFDVWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 196 - DNA, 2993 bp, Artificial Sequence
  (BCMA-A7D-CS1-hu63-2G, CD269-A7D-CS1-hu63-2G CD269-A7D-28-2G CAR nucleotide sequence)
atggccttaccagtgaccgccttgctcctgccgctggccttgctgctccacgccgccaggccggacgtggtgatgacccagagccacaggttcatgagcaccagcgtgggcgacagggtgagcatcacctgcagggccagccaggacgtgaacaccgccgtgagctggtaccagcagaagcccggccagagccccaagctgctgatcttcagcgccagctacaggtacaccggcgtgcccgacaggttcaccggcagcggcagcggcgccgacttcaccctgaccatcagcagcgtgcaggccgaggacctggccgtgtactactgccagcagcactacagcaccccctggaccttcggcggcggcaccaagctggacatcaagggaggggggggatccgggggaggaggctccggcggaggcggaagccagatccagctggtgcagagcggccccgacctgaagaagcccggcgagaccgtgaagctgagctgcaaggccagcggctacaccttcaccaacttcggcatgaactgggtgaagcaggcccccggcaagggcttcaagtggatggcctggatcaacacctacaccggcgagagctacttcgccgacgacttcaagggcaggttcgccttcagcgtggagaccagcgccaccaccgcctacctgcagatcaacaacctgaagaccgaggacaccgccacctacttctgcgccaggggcgagatctactacggctacgacggcggcttcgcctactggggccagggcaccctggtgaccgtgagcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccttaccagtgaccgccttgctcctgccgctggccttgctgctccacgccgccaggccggacatccagatgacccagagccccagcagcctgagcgccagcgtgggcgacagggtgaccatcacctgcaaggccagccaggacgtgggcatcgccgtggcctggtaccagcagaagcccggcaaggtgcccaagctgctgatctactgggccagcaccaggcacaccggcgtgcccgacaggttcagcggcagcggcagcggcaccgacttcaccctgaccatcagcagcctgcagcccgaggacgtggccacctactactgccagcagtacagcagctacccctacaccttcggccagggcaccaaggtggagatcaagggaggggggggatccgggggaggaggctccggcggaggcggaagcgaggtgcagctggtggagagcggcggcggcctggtgcagcccggcggcagcctgaggctgagctgcgccgccagcggcttcttcagcaggtactggatgagctgggtgaggcaggcccccggcaagggcctggagtggatcggcgagatcaaccccgacagcagcaccatcaactacgcccccagcctgaaggacaagttcatcatcagcagggacaacgccaagaacagcctgtacctgcagatgaacagcctgagggccgaggacaccgccgtgtactactgcgccaggcccgacggcaactactggtacttcgacgtgtggggccagggcaccctggtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 197 - protein, 995 aa, Artificial Sequence
  (BCMA-A7D-CS1-mu90-2G, CD269-A7D-CS1-mu90-2G CAR amino acid sequence)
MALPVTALLLPLALLLHAARPDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKGGGGSGGGGSGGGGSQIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNKFKDKATLTVDKSSSTAYMQLSSPTSEDSAVYYCARSTMIATRAMDYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 198 - DNA, 2996 bp, Artificial Sequence
  (BCMA-A7D-CS1-mu90-2G, CD269-A7D-CS1-mu90-2G CAR nucleotide sequence
atggccttaccagtgaccgccttgctcctgccgctggccttgctgctccacgccgccaggccggacgtggtgatgacccagagccacaggttcatgagcaccagcgtgggcgacagggtgagcatcacctgcagggccagccaggacgtgaacaccgccgtgagctggtaccagcagaagcccggccagagccccaagctgctgatcttcagcgccagctacaggtacaccggcgtgcccgacaggttcaccggcagcggcagcggcgccgacttcaccctgaccatcagcagcgtgcaggccgaggacctggccgtgtactactgccagcagcactacagcaccccctggaccttcggcggcggcaccaagctggacatcaagggaggggggggatccgggggaggaggctccggcggaggcggaagccagatccagctggtgcagagcggccccgacctgaagaagcccggcgagaccgtgaagctgagctgcaaggccagcggctacaccttcaccaacttcggcatgaactgggtgaagcaggcccccggcaagggcttcaagtggatggcctggatcaacacctacaccggcgagagctacttcgccgacgacttcaagggcaggttcgccttcagcgtggagaccagcgccaccaccgcctacctgcagatcaacaacctgaagaccgaggacaccgccacctacttctgcgccaggggcgagatctactacggctacgacggcggcttcgcctactggggccagggcaccctggtgaccgtgagcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccttaccagtgaccgccttgctcctgccgctggccttgctgctccacgccgccaggccggacatcgtgatgacccagagccagaagagcatgagcaccagcgtgggcgacagggtgagcatcacctgcaaggccagccaggacgtgatcaccggcgtggcctggtaccagcagaagcccggccagagccccaagctgctgatctacagcgccagctacaggtacaccggcgtgcccgacaggttcaccggcagcggcagcggcaccgacttcaccttcaccatcagcaacgtgcaggccgaggacctggccgtgtactactgccagcagcactacagcacccccctgaccttcggcgccggcaccaagctggagctgaagggaggggggggatccgggggaggaggctccggcggaggcggaagccaggtgcagctgcagcagcccggcgccgagctggtgaggcccggcgccagcgtgaagctgagctgcaaggccagcggctacagcttcaccacctactggatgaactgggtgaagcagaggcccggccagggcctggagtggatcggcatgatccaccccagcgacagcgagaccaggctgaacaagttcaaggacaaggccaccctgaccgtggacaagagcagcagcaccgcctacatgcagctgagcagccccaccagcgaggacagcgccgtgtactactgcgccaggagcaccatgatcgccaccagggccatggactactggggccagggcaccagcgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 199 - protein, 993 aa, Artificial Sequence
  (BCMA-C11D-CS1-hu63-2G, CD269-C11D-CS1-hu63-2G CAR amino acid sequence)
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFFSRYWMSWVRQAPGKGLEWIGEINPDSSTINYAPSLKDKFIISRDNAKNSLYLQMNSLRAEDTAVYYCARPDGNYWYFDVWGQGTLVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 200 - DNA, 2990 bp, Artificial Sequence
  (BCMA-C11D-CS1-hu63-2G, CD269-C11D-CS1-hu63-2G CAR nucleotide sequence)
atggccttaccagtgaccgccttgctcctgccgctggccttgctgctccacgccgccaggccggacatcgtgctgacccagagcccccccagcctggccatgagcctgggcaagagggccaccatcagctgcagggccagcgagagcgtgaccatcctgggcagccacctgatccactggtaccagcagaagcccggccagccccccaccctgctgatccagctggccagcaacgtgcagaccggcgtgcccgccaggttcagcggcagcggcagcaggaccgacttcaccctgaccatcgaccccgtggaggaggacgacgtggccgtgtactactgcctgcagagcaggaccatccccaggaccttcggcggcggcaccaagctggagatcaagggaggggggggatccgggggaggaggctccggcggaggcggaagccagatccagctggtgcagagcggccccgagctgaagaagcccggcgagaccgtgaagatcagctgcaaggccagcggctacaccttcaccgactacagcatcaactgggtgaagagggcccccggcaagggcctgaagtggatgggctggatcaacaccgagaccagggagcccgcctacgcctacgacttcaggggcaggttcgccttcagcctggagaccagcgccagcaccgcctacctgcagatcaacaacctgaagtacgaggacaccgccacctacttctgcgccctggactacagctacgccatggactactggggccagggcaccagcgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccttaccagtgaccgccttgctcctgccgctggccttgctgctccacgccgccaggccggacatccagatgacccagagccccagcagcctgagcgccagcgtgggcgacagggtgaccatcacctgcaaggccagccaggacgtgggcatcgccgtggcctggtaccagcagaagcccggcaaggtgcccaagctgctgatctactgggccagcaccaggcacaccggcgtgcccgacaggttcagcggcagcggcagcggcaccgacttcaccctgaccatcagcagcctgcagcccgaggacgtggccacctactactgccagcagtacagcagctacccctacaccttcggccagggcaccaaggtggagatcaagggaggggggggatccgggggaggaggctccggcggaggcggaagcgaggtgcagctggtggagagcggcggcggcctggtgcagcccggcggcagcctgaggctgagctgcgccgccagcggcttcttcagcaggtactggatgagctgggtgaggcaggcccccggcaagggcctggagtggatcggcgagatcaaccccgacagcagcaccatcaactacgcccccagcctgaaggacaagttcatcatcagcagggacaacgccaagaacagcctgtacctgcagatgaacagcctgagggccgaggacaccgccgtgtactactgcgccaggcccgacggcaactactggtacttcgacgtgtggggccagggcaccctggtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 201 - protein, 996 aa, Artificial Sequence
  (BCMA-C11D-CS1-mu34-2G, CD269-C11D-CS1-mu34-2G CAR amino acid sequence)
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIQMTQSSSYLSVSLGGRVTITCKASDHINNWLAWYQQKPGNAPRLLISGATSLETGVPSRFSGSGSGKDYTLSITSLQTEDVATYYCQQYWSTPWTFGGGTKLEIKGGGGSGGGGSGGGGSQVQLQQSGAELARPGASVKLSCKASGYTFTSYWMQWVKQRPGQGLEWIGAIYPGDGDTRYTQKFKGKATLTADKSSSTAYMQLSSLASEDSAVYYCARGKVYYGSNPFAYWGQGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 202 - DNA, 2999 bp, Artificial Sequence
  (BCMA-C11D-CS1-mu34-2G, CD269-C11D-CS1-mu34-2G CAR nucleotide sequence)
atggccttaccagtgaccgccttgctcctgccgctggccttgctgctccacgccgccaggccggacatcgtgctgacccagagcccccccagcctggccatgagcctgggcaagagggccaccatcagctgcagggccagcgagagcgtgaccatcctgggcagccacctgatccactggtaccagcagaagcccggccagccccccaccctgctgatccagctggccagcaacgtgcagaccggcgtgcccgccaggttcagcggcagcggcagcaggaccgacttcaccctgaccatcgaccccgtggaggaggacgacgtggccgtgtactactgcctgcagagcaggaccatccccaggaccttcggcggcggcaccaagctggagatcaagggaggggggggatccgggggaggaggctccggcggaggcggaagccagatccagctggtgcagagcggccccgagctgaagaagcccggcgagaccgtgaagatcagctgcaaggccagcggctacaccttcaccgactacagcatcaactgggtgaagagggcccccggcaagggcctgaagtggatgggctggatcaacaccgagaccagggagcccgcctacgcctacgacttcaggggcaggttcgccttcagcctggagaccagcgccagcaccgcctacctgcagatcaacaacctgaagtacgaggacaccgccacctacttctgcgccctggactacagctacgccatggactactggggccagggcaccagcgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccttaccagtgaccgccttgctcctgccgctggccttgctgctccacgccgccaggccggacatccagatgacccagagcagcagctacctgagcgtgagcctgggcggcagggtgaccatcacctgcaaggccagcgaccacatcaacaactggctggcctggtaccagcagaagcccggcaacgcccccaggctgctgatcagcggcgccaccagcctggagaccggcgtgcccagcaggttcagcggcagcggcagcggcaaggactacaccctgagcatcaccagcctgcagaccgaggacgtggccacctactactgccagcagtactggagcaccccctggaccttcggcggcggcaccaagctggagatcaagggaggggggggatccgggggaggaggctccggcggaggcggaagccaggtgcagctgcagcagagcggcgccgagctggccaggcccggcgccagcgtgaagctgagctgcaaggccagcggctacaccttcaccagctactggatgcagtgggtgaagcagaggcccggccagggcctggagtggatcggcgccatctaccccggcgacggcgacaccaggtacacccagaagttcaagggcaaggccaccctgaccgccgacaagagcagcagcaccgcctacatgcagctgagcagcctggccagcgaggacagcgccgtgtactactgcgccaggggcaaggtgtactacggcagcaaccccttcgcctactggggccagggcaccctggtgaccgtgagcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 203 - protein, 994 aa, Artificial Sequence
  BCMA-C11D-CS1-mu90-2G, CD269-C11D-CS1-mu90-2G CAR amino acid sequence)
MALPVTALLLPLALLLHAARPDIVLTQSPPSLAMSLGKRATISCRASESVTILGSHLIHWYQQKPGQPPTLLIQLASNVQTGVPARFSGSGSRTDFTLTIDPVEEDDVAVYYCLQSRTIPRTFGGGTKLEIKGGGGSGGGGSGGGGSQIQLVQSGPELKKPGETVKISCKASGYTFTDYSINWVKRAPGKGLKWMGWINTETREPAYAYDFRGRFAFSLETSASTAYLQINNLKYEDTATYFCALDYSYAMDYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIVMTQSQKSMSTSVGDRVSITCKASQDVITGVAWYQQKPGQSPKLLIYSASYRYTGVPDRFTGSGSGTDFTFTISNVQAEDLAVYYCQQHYSTPLTFGAGTKLELKGGGGSGGGGSGGGGSQVQLQQPGAELVRPGASVKLSCKASGYSFTTYWMNWVKQRPGQGLEWIGMIHPSDSETRLNKFKDKATLTVDKSSSTAYMQLSSPTSEDSAVYYCARSTMIATRAMDYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 204 - DNA, 2993 bp, Artificial Sequence
  (BCMA-C11D-CS1-mu90-2G, CD269-C11D-CS1-mu90-2G CAR nucleotide sequence)
atggccttaccagtgaccgccttgctcctgccgctggccttgctgctccacgccgccaggccggacatcgtgctgacccagagcccccccagcctggccatgagcctgggcaagagggccaccatcagctgcagggccagcgagagcgtgaccatcctgggcagccacctgatccactggtaccagcagaagcccggccagccccccaccctgctgatccagctggccagcaacgtgcagaccggcgtgcccgccaggttcagcggcagcggcagcaggaccgacttcaccctgaccatcgaccccgtggaggaggacgacgtggccgtgtactactgcctgcagagcaggaccatccccaggaccttcggcggcggcaccaagctggagatcaagggaggggggggatccgggggaggaggctccggcggaggcggaagccagatccagctggtgcagagcggccccgagctgaagaagcccggcgagaccgtgaagatcagctgcaaggccagcggctacaccttcaccgactacagcatcaactgggtgaagagggcccccggcaagggcctgaagtggatgggctggatcaacaccgagaccagggagcccgcctacgcctacgacttcaggggcaggttcgccttcagcctggagaccagcgccagcaccgcctacctgcagatcaacaacctgaagtacgaggacaccgccacctacttctgcgccctggactacagctacgccatggactactggggccagggcaccagcgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccttaccagtgaccgccttgctcctgccgctggccttgctgctccacgccgccaggccggacatcgtgatgacccagagccagaagagcatgagcaccagcgtgggcgacagggtgagcatcacctgcaaggccagccaggacgtgatcaccggcgtggcctggtaccagcagaagcccggccagagccccaagctgctgatctacagcgccagctacaggtacaccggcgtgcccgacaggttcaccggcagcggcagcggcaccgacttcaccttcaccatcagcaacgtgcaggccgaggacctggccgtgtactactgccagcagcactacagcacccccctgaccttcggcgccggcaccaagctggagctgaagggaggggggggatccgggggaggaggctccggcggaggcggaagccaggtgcagctgcagcagcccggcgccgagctggtgaggcccggcgccagcgtgaagctgagctgcaaggccagcggctacagcttcaccacctactggatgaactgggtgaagcagaggcccggccagggcctggagtggatcggcatgatccaccccagcgacagcgagaccaggctgaacaagttcaaggacaaggccaccctgaccgtggacaagagcagcagcaccgcctacatgcagctgagcagccccaccagcgaggacagcgccgtgtactactgcgccaggagcaccatgatcgccaccagggccatggactactggggccagggcaccagcgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 205 - protein, 1293 aa, Artificial Sequence
  (BCMA-CS1-BB-IL-15/IL-15sushi, CD269-CS1-BB-IL-15/IL-15sushi CAR amino acid sequence)
MALPVTALLLPLALLLHAARPDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKGGGGSGGGGSGGGGSQIQLVQSGPDLKKPGETVKLSCKASGYTFTNFGMNWVKQAPGKGFKWMAWINTTRYTGESYFADDFKGRFAFSVETSATTAYLQINNLKTEDTATYFCARGEIYYGYDGGFAYWGQGTLVTVSATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPDIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKGGGGSGGGGSGGGGSEVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 206 - DNA, 3879 bp, Artificial Sequence
  (BCMA-CS1-BB-IL-15/IL-15sushi, CD269-CS1-BB-IL-15/IL-15sushi CAR nucleotide sequence)
agtgaccgccttgctcctgccgctggccttgctgctccacgccgccaggccggatgtggtgatgacccagagccatcgctttatgagcaccagcgtgggcgaccgagtgagcattacctgccgcgcgagccaggatgtgaacaccgcggtgagctggtatcagcagaaaccgggccagagcccgaaactgctgatttttagcgcgagctatcgctataccggcgtgccggatcgctttaccggcagcggcagcggcgcggattttaccctgaccattagcagcgtgcaggcggaagatctggcggtgtattattgccagcagcattatagcaccccgtggacctttggcggcggcaccaaactggacattaaaggaggggggggatccgggggaggaggctccggcggaggcggaagccagattcagctggtgcagagcggcccggatctgaaaaaaccgggcgaaaccgtgaaactgagctgcaaagcgagcggctatacctttaccaactttggcatgaactgggtgaaacaggcgccgggcaaaggctttaaatggatggcgtggattaacaccacccgctataccggcgaaagctattttgcggatgattttaaaggccgctttgcgtttagcgtggaaaccagcgcgaccaccgcgtatctgcagattaacaacctgaaaaccgaagataccgcgacctatttttgcgcgcgcggcgaaatttattatggctatgatggcggctttgcgtattggggccagggcaccctggtgaccgtgagcgcgaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccctgcccgtgaccgccctgctgctgcccctggccctgctgctgcacgccgccaggcccgatattcagatgacccagagcccgagcagcctgagcgcgagcgtgggcgaccgggtgaccattacctgcaaagcgagccaggatgtgggcattgcggtggcgtggtatcagcagaaaccgggcaaagtgccgaaactgctgatttattgggcgagcacccgccataccggcgtgccggatcgctttagcggcagcggcagcggcaccgattttaccctgaccattagcagcctgcagccggaagatgtggcgacctattattgccagcagtatagcagctatccgtatacctttggccagggcaccaaagtggaaattaaaggaggggggggatccgggggaggaggctccggcggaggcggaagcgaagtgcagctggtggaaagcggcggcggcctggtgcagccgggcggcagcctgcgcctgagctgcgcggcgagcggctttgattttagccgctattggatgagctgggtgcgccaggcgccgggcaaaggcctggaatggattggcgaaattaacccggatagcagcaccattaactatgcgccgagcctgaaagataaatttattattagccgcgataacgcgaaaaacagcctgtatctgcagatgaacagcctgcgcgcggaagataccgcggtgtattattgcgcgcgcccggatggcaactattggtattttgatgtgtggggccagggcaccctggtgaccgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaagaggggcaggaagaagctgctgtacatcttcaagcagcccttcatgaggcccgtgcagaccacccaggaggaggacggctgcagctgcaggttccccgaggaggaggagggcggctgcgagctgagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggggcagcggcgaaggccgcggcagcctgctgacctgcggcgatgtggaagaaaacccgggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 207 - protein, 663 aa, Artificial Sequence
  (BCMA-A7D-28-IL-15, CD269-A7D-28-IL-15 CAR amino acid sequence)
MALPVTALLLPLALLLHAARPDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKGGGGSGGGGSGGGGSQIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 208 - DNA, 2000 bp, Artificial Sequence
  (BCMA-A7D-28-IL-15, CD269-A7D-28-IL-15 CAR nucleotide sequence)
atggccttaccagtgaccgccttgctcctgccgctggccttgctgctccacgccgccaggccggacgtggtgatgacccagagccacaggttcatgagcaccagcgtgggcgacagggtgagcatcacctgcagggccagccaggacgtgaacaccgccgtgagctggtaccagcagaagcccggccagagccccaagctgctgatcttcagcgccagctacaggtacaccggcgtgcccgacaggttcaccggcagcggcagcggcgccgacttcaccctgaccatcagcagcgtgcaggccgaggacctggccgtgtactactgccagcagcactacagcaccccctggaccttcggcggcggcaccaagctggacatcaagggaggggggggatccgggggaggaggctccggcggaggcggaagccagatccagctggtgcagagcggccccgacctgaagaagcccggcgagaccgtgaagctgagctgcaaggccagcggctacaccttcaccaacttcggcatgaactgggtgaagcaggcccccggcaagggcttcaagtggatggcctggatcaacacctacaccggcgagagctacttcgccgacgacttcaagggcaggttcgccttcagcgtggagaccagcgccaccaccgcctacctgcagatcaacaacctgaagaccgaggacaccgccacctacttctgcgccaggggcgagatctactacggctacgacggcggcttcgcctactggggccagggcaccctggtgaccgtgagcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctaagtttaaac

SEQ ID NO: 209 - protein, 672 aa, Artificial Sequence
  (CD33b-28-IL-15 CAR amino acid sequence)
MALPVTALLLPLALLLHAARPMADYKDIVMTQSHKFLLVSVGDRVSITCKASQDVSTAVAWYQQKPGQSPKLLIYSASYRYTGVPDRFIGSGSGTDFTLTISSVQAEDLADYFCQQHYSTPLTFGAGTKLEIKRGGGGSGGGGSGGGGSSGGGSEVQLKESGPGLVAPSQSLSITCTVSGFPLTSYGVSWVRQPPGKGLEWLGVIWGDGSTNYHSALISRLSISKDNSKSQVFLKLNNLQTDDTATYYCARDTYYPYYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 210 - DNA, 2027 bp, Artificial Sequence
  (CD33b-28-IL-15 , CD33b-BB-IL15xp-2G CAR nucleotide sequence)
atggccctgcccgtgaccgccctgctgctgcccctggccctgctgctgcacgccgccaggcccatggccgactacaaggacatcgtgatgacccagagccacaagttcctgctggtgagcgtgggcgacagggtgagcatcacctgcaaggccagccaggacgtgagcaccgccgtggcctggtaccagcagaagcccggccagagccccaagctgctgatctacagcgccagctacaggtacaccggcgtgcccgacaggttcatcggcagcggcagcggcaccgacttcaccctgaccatcagcagcgtgcaggccgaggacctggccgactacttctgccagcagcactacagcacccccctgaccttcggcgccggcaccaagctggagatcaagaggggcggcggcggcagcggcggcggcggcagcggcggcggcggcagcagcggcggcggcagcgaggtgcagctgaaggagagcggccccggcctggtggcccccagccagagcctgagcatcacctgcaccgtgagcggcttccccctgaccagctacggcgtgagctgggtgaggcagccccccggcaagggcctggagtggctgggcgtgatctggggcgacggcagcaccaactaccacagcgccctgatcagcaggctgagcatcagcaaggacaacagcaagagccaggtgttcctgaagctgaacaacctgcagaccgacgacaccgccacctactactgcgccagggacacctactacccctactacgccatggactactggggccagggcaccagcgtgaccgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaaacggggcagaaagaaactcctgtatatattcaaacaaccatttatgagaccagtacaaactactcaagaggaagatggctgtagctgccgatttccagaagaagaagaaggaggatgtgaactgagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctaagtttaaac

SEQ ID NO: 211 - protein, 669 aa, Artificial Sequence
  (CD19bb-BB-IL-15 CAR amino acid sequence)
MALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 212 - DNA, 2018 bp, Artificial Sequence
  (CD19b-BB-IL-15 CAR nucleotide sequence)
atggccttaccagtgaccgccttgctcctgccgctggccttgctgctccacgccgccaggccggaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaaacggggcagaaagaaactcctgtatatattcaaacaaccatttatgagaccagtacaaactactcaagaggaagatggctgtagctgccgatttccagaagaagaagaaggaggatgtgaactgagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctaagtttaaac

SEQ ID NO: 213 - protein, 821 aa, Artificial Sequence; identical to SEQ ID NO: 142
  (CD269-A7D-28-IL-15/IL-15sushi anchor CAR nucleotide sequence)

SEQ ID NO: 214 - DNA, 2466 bp, Artificial Sequence
  (CD269-A7D-28-IL-15/IL-15sushi anchor CAR nucleotide sequence)
atggccttaccagtgaccgccttgctcctgccgctggccttgctgctccacgccgccaggccggacgtggtgatgacccagagccacaggttcatgagcaccagcgtgggcgacagggtgagcatcacctgcagggccagccaggacgtgaacaccgccgtgagctggtaccagcagaagcccggccagagccccaagctgctgatcttcagcgccagctacaggtacaccggcgtgcccgacaggttcaccggcagcggcagcggcgccgacttcaccctgaccatcagcagcgtgcaggccgaggacctggccgtgtactactgccagcagcactacagcaccccctggaccttcggcggcggcaccaagctggacatcaagggaggggggggatccgggggaggaggctccggcggaggcggaagccagatccagctggtgcagagcggccccgacctgaagaagcccggcgagaccgtgaagctgagctgcaaggccagcggctacaccttcaccaacttcggcatgaactgggtgaagcaggcccccggcaagggcttcaagtggatggcctggatcaacacctacaccggcgagagctacttcgccgacgacttcaagggcaggttcgccttcagcgtggagaccagcgccaccaccgcctacctgcagatcaacaacctgaagaccgaggacaccgccacctacttctgcgccaggggcgagatctactacggctacgacggcggcttcgcctactggggccagggcaccctggtgaccgtgagcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcagatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagaaccaccacccccgcccccaggccccccacccccgcccccaccatcgccagccagcccctgagcctgaggcccgaggcctgcaggcccgccgccggcggcgccgtgcacaccaggggcctggacttcgcctgcgacgtggctatctccacgtccactgtcctgctgtgtgggctgagcgctgtgtctctcctggcatgctactaa

SEQ ID NO: 215 - protein, 785 aa, Artificial Sequence
  (CD269-A7D-28-IL-15/IL-15sushi-2G CAR amino acid sequence)
DRTMALPVTALLLPLALLLHAARPDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKGGGGSGGGGSGGGGSQIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 216 - DNA, 2357 bp, Artificial Sequence; identical to SEQ ID NO: 149
  (CD269-A7D-28-IL-15/IL-15sushi-2G CAR nucleotide sequence)

SEQ ID NO: 217 - protein, 486 aa, Artificial Sequence
  (GD2-3F8-BB-2G CAR amino acid sequence)
MALPVTALLLPLALLLHAARPQVQLKESGPGLVAPSQSLSITCTVSGFSVTNYGVHWVRQPPGKGLEWLGVIWAGGITNYNSAFMSRLSISKDNSKSQVFLKMNSLQIDDTAMYYCASRGGHYGYALDYWGQGTSVTVSSGGGGSGGGGSGGGGSSIVMTQTPKFLLVSAGDRVTITCKASQSVSNDVTWYQQKAGQSPKLLIYSASNRYSGVPDRFTGSGYGTAFTFTISTVQAEDLAVYFCQQDYSSFGGGTKLEIKRTVTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 218 - DNA, 1480 bp, Artificial Sequence
  (GD2-3F8-BB-2G CAR nucleotide sequence)
gcgatcgcaccatggccctgcccgtgaccgccctgctgctgcccctggccctgctgctgcacgccgccaggccccaggtgcagctgaaggagagcggccccggcctggtggcccccagccagagcctgagcatcacctgcaccgtgagcggcttcagcgtgaccaactacggcgtgcactgggtgaggcagccccccggcaagggcctggagtggctgggcgtgatctgggccggcggcatcaccaactacaacagcgccttcatgagcaggctgagcatcagcaaggacaacagcaagagccaggtgttcctgaagatgaacagcctgcagatcgacgacaccgccatgtactactgcgccagcaggggcggccactacggctacgccctggactactggggccagggcaccagcgtgaccgtgagcagcggaggggggggatccgggggaggaggctccggcggaggcggaagcagcatcgtgatgacccagacccccaagttcctgctggtgagcgccggcgacagggtgaccatcacctgcaaggccagccagagcgtgagcaacgacgtgacctggtaccagcagaaggccggccagagccccaagctgctgatctacagcgccagcaacaggtacagcggcgtgcccgacaggttcaccggcagcggctacggcaccgccttcaccttcaccatcagcaccgtgcaggccgaggacctggccgtgtacttctgccagcaggactacagcagcttcggcggcggcaccaagctggagatcaagaggaccgtgaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaaacggggcagaaagaaactcctgtatatattcaaacaaccatttatgagaccagtacaaactactcaagaggaagatggctgtagctgccgatttccagaagaagaagaaggaggatgtgaactgagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 219 - protein, 483 aa, Artificial Sequence
  (GD2-3G6-BB-2G CAR amino acid sequence)
MALPVTALLLPLALLLHAARPSIVMTQTPKFLLVSAGDRVTITCKASQSVSNDVAWYQQKPGQSPKLLIYSASNRYTGVPDRFTGSGYGTDFTFTISTVQAEDLAVYFCQQDYSSLGGGTKLEIKGGGGSGGGGSGGGGSQVQVKESGPGLVAPSQSLSITCTVSGFSLTNYGVHWVRQPPGKGLEWLGVIWAGGSTNYNSALMSRLSISKDNSKSQVFLKMNSLQTDDTAMYYCASRGGNYGYALDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 220 - DNA, 1471 bp, Artificial Sequence
  (GD2-3G6-BB-2G CAR nucleotide sequence)
gcgatcgcaccatggccctgcccgtgaccgccctgctgctgcccctggccctgctgctgcacgccgccaggcccagtattgtgatgacccagactcccaaattcctgcttgtatcagcaggagacagggttaccataacctgcaaggccagtcagagtgtgagtaatgatgtggcttggtaccaacagaagccagggcagtctccgaaactgctgatatactctgcatccaatcgctacactggagtccctgatcgcttcactggcagtggatatgggacggatttcactttcaccatcagcactgtgcaggctgaagacctggcagtttatttctgtcagcaggattatagctcgctcggaggggggaccaagctggaaataaaaggtggaggcggttcaggcggaggtggctctggcggtggcggatcgcaggtgcaggtgaaggagtcaggacctggcctggtggcgccctcacagagcctgtccatcacttgcactgtctctgggttttcattaaccaattatggtgtacactgggttcgccagcctccaggaaagggtctggagtggctgggagtaatatgggctggtggaagcacaaattataattcggctcttatgtccagactgagcatcagcaaggacaactccaagagccaagttttcttaaaaatgaacagtctgcaaactgatgacacagccatgtactactgtgccagtcgggggggtaactacggctatgctttggactactggggtcaaggaacctcagtcaccgtctcctcaaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaaacggggcagaaagaaactcctgtatatattcaaacaaccatttatgagaccagtacaaactactcaagaggaagatggctgtagctgccgatttccagaagaagaagaaggaggatgtgaactgagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 221 - protein, 488 aa, Artificial Sequence
  (GD2-8H9-BB-2G CAR amino acid sequence)
MALPVTALLLPLALLLHAARPQVKLQQSGAELVKPGASVKLSCKASGYTFTNYDINWVRQRPEQGLEWIGWIFPGDGSTQYNEKFKGKATLTTDTSSSTAYMQLSRLTSEDSAVYFCARQTTATWFAYWGQGTTVTVSSDGGGSGGGGSGGGGSDIELTQSPTTLSVTPGDRVSLSCRASQSISDYLHWYQQKSHESPRLLIKYASQSISGIPSRFSGSGSGSDFTLSINSVEPEDVGVYYCQNGHSFPLTFGAGTKLELKQAATTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 222 - DNA, 1486 bp, Artificial Sequence
  (GD2-8H9-BB-2G CAR nucleotide sequence)
gcgatcgcaccatggccctgcccgtgaccgccctgctgctgcccctggccctgctgctgcacgccgccaggccccaggtcaaactgcagcagtctggggctgaactggtaaagcctggggcttcagtgaaattgtcctgcaaggcttctggctacaccttcacaaactatgatataaactgggtgaggcagaggcctgaacagggacttgagtggattggatggatcttccccggcgacggcagcacccagtacaacgagaagttcaagggcaaggccaccctgaccaccgacaccagcagcagcaccgcctacatgcagctgagcaggctgaccagcgaggactctgctgtctatttctgtgcaagacagactacggctacctggtttgcttactggggccaagggaccacggtcaccgtctcctcagatggaggcggttcaggcggaggtggctctggcggtggcggatcggacatcgagctcactcagtctccaaccaccctgtctgtgactccaggagatagagtctctctttcctgcagggccagccagagtattagcgactacttacactggtaccaacaaaaatcacatgagtctccaaggcttctcatcaaatatgcttcccaatccatctctgggatcccctccaggttcagtggcagtggatcagggtcagatttcactctcagtatcaacagtgtggaacctgaagatgttggagtgtattactgtcaaaatggtcacagctttccgctcacgttcggtgctgggaccaagctggagctgaaacaggcggccaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaaacggggcagaaagaaactcctgtatatattcaaacaaccatttatgagaccagtacaaactactcaagaggaagatggctgtagctgccgatttccagaagaagaagaaggaggatgtgaactgagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 223 - protein, 486 aa, Artificial Sequence
  (GD2-28-2G CAR amino acid sequence)
MALPVTALLLPLALLLHAARPEIVMTQSPATLSVSPGERATLSCRSSQSLVHRNGNTYLHWYLQKPGQSPKLLIHKVSNRFSGVPDRFSGSGSGTDFTLKISRVEAEDLGVYFCSQSTHVPPLTFGAGTKLELKRGGGGSGGGGSGGGGSEVQLLQSGPELEKPGASVMISCKASGSSFTGYNMNWVRQNIGKSLEWIGAIDPYYGGTSYNQKFKGRATLTVDKSSSTAYMHLKSLTSEDSAVYYCVSGMEYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 224 - DNA, 1480 bp, Artificial Sequence
  (GD2-28-2G CAR nucleotide sequence)
gcgatcgcaccatggccttaccagtgaccgccttgctcctgccgctggccttgctgctccacgccgccaggccggagatcgtgatgacccagagccccgccaccctgagcgtgagccccggcgagagggccaccctgagctgcaggagcagccagagcctggtgcacaggaacggcaacacctacctgcactggtacctgcagaagcccggccagagccccaagctgctgatccacaaggtgagcaacaggttcagcggcgtgcccgacaggttcagcggcagcggcagcggcaccgacttcaccctgaagatcagcagggtggaggccgaggacctgggcgtgtacttctgcagccagagcacccacgtgccccccctgaccttcggcgccggcaccaagctggagctgaagaggggcggcggcggcagcggcggcggcggcagcggcggcggcggcagcgaggtgcagctgctgcagagcggccccgagctggagaagcccggcgccagcgtgatgatcagctgcaaggccagcggcagcagcttcaccggctacaacatgaactgggtgaggcagaacatcggcaagagcctggagtggatcggcgccatcgacccctactacggcggcaccagctacaaccagaagttcaagggcagggccaccctgaccgtggacaagagcagcagcaccgcctacatgcacctgaagagcctgaccagcgaggacagcgccgtgtactactgcgtgagcggcatggagtactggggccagggcaccagcgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 225 - protein, 1057 aa, Artificial Sequence
  (GD2-28-2G-41BBL-IL15/IL-15sushi CAR amino acid sequence)
MALPVTALLLPLALLLHAARPEIVMTQSPATLSVSPGERATLSCRSSQSLVHRNGNTYLHWYLQKPGQSPKLLIHKVSNRFSGVPDRFSGSGSGTDFTLKISRVEAEDLGVYFCSQSTHVPPLTFGAGTKLELKRGGGGSGGGGSGGGGSEVQLLQSGPELEKPGASVMISCKASGSSFTGYNMNWVRQNIGKSLEWIGAIDPYYGGTSYNQKFKGRATLTVDKSSSTAYMHLKSLTSEDSAVYYCVSGMEYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSGATNFLSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 226 - DNA, 3193 bp, Artificial Sequence
  (GD2-28-2G-41BBL-IL15/IL-15sushi CAR nucleotide sequence)
gcgatcgcaccatggccttaccagtgaccgccttgctcctgccgctggccttgctgctccacgccgccaggccggagatcgtgatgacccagagccccgccaccctgagcgtgagccccggcgagagggccaccctgagctgcaggagcagccagagcctggtgcacaggaacggcaacacctacctgcactggtacctgcagaagcccggccagagccccaagctgctgatccacaaggtgagcaacaggttcagcggcgtgcccgacaggttcagcggcagcggcagcggcaccgacttcaccctgaagatcagcagggtggaggccgaggacctgggcgtgtacttctgcagccagagcacccacgtgccccccctgaccttcggcgccggcaccaagctggagctgaagaggggcggcggcggcagcggcggcggcggcagcggcggcggcggcagcgaggtgcagctgctgcagagcggccccgagctggagaagcccggcgccagcgtgatgatcagctgcaaggccagcggcagcagcttcaccggctacaacatgaactgggtgaggcagaacatcggcaagagcctggagtggatcggcgccatcgacccctactacggcggcaccagctacaaccagaagttcaagggcagggccaccctgaccgtggacaagagcagcagcaccgcctacatgcacctgaagagcctgaccagcgaggacagcgccgtgtactactgcgtgagcggcatggagtactggggccagggcaccagcgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaaggaagcggagctactaacttcttgagcctgctgaagcaggctggagacgtggaggagaaccctggacctatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 227 - protein, 661 aa, Artificial Sequence
  (GD2-28-2G-IL15xp CAR amino acid sequence)
MALPVTALLLPLALLLHAARPEIVMTQSPATLSVSPGERATLSCRSSQSLVHRNGNTYLHWYLQKPGQSPKLLIHKVSNRFSGVPDRFSGSGSGTDFTLKISRVEAEDLGVYFCSQSTHVPPLTFGAGTKLELKRGGGGSGGGGSGGGGSEVQLLQSGPELEKPGASVMISCKASGSSFTGYNMNWVRQNIGKSLEWIGAIDPYYGGTSYNQKFKGRATLTVDKSSSTAYMHLKSLTSEDSAVYYCVSGMEYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 228 - DNA, 2005 bp, Artificial Sequence
  (GD2-28-2G-IL15xp CAR nucleotide sequence)
gcgatcgcaccatggccttaccagtgaccgccttgctcctgccgctggccttgctgctccacgccgccaggccggagatcgtgatgacccagagccccgccaccctgagcgtgagccccggcgagagggccaccctgagctgcaggagcagccagagcctggtgcacaggaacggcaacacctacctgcactggtacctgcagaagcccggccagagccccaagctgctgatccacaaggtgagcaacaggttcagcggcgtgcccgacaggttcagcggcagcggcagcggcaccgacttcaccctgaagatcagcagggtggaggccgaggacctgggcgtgtacttctgcagccagagcacccacgtgccccccctgaccttcggcgccggcaccaagctggagctgaagaggggcggcggcggcagcggcggcggcggcagcggcggcggcggcagcgaggtgcagctgctgcagagcggccccgagctggagaagcccggcgccagcgtgatgatcagctgcaaggccagcggcagcagcttcaccggctacaacatgaactgggtgaggcagaacatcggcaagagcctggagtggatcggcgccatcgacccctactacggcggcaccagctacaaccagaagttcaagggcagggccaccctgaccgtggacaagagcagcagcaccgcctacatgcacctgaagagcctgaccagcgaggacagcgccgtgtactactgcgtgagcggcatggagtactggggccagggcaccagcgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctaagtttaaac

SEQ ID NO: 229 - protein, 761 aa, Artificial Sequence
  (GD2-28-41BBL CAR amino acid sequence)
MALPVTALLLPLALLLHAARPEIVMTQSPATLSVSPGERATLSCRSSQSLVHRNGNTYLHWYLQKPGQSPKLLIHKVSNRFSGVPDRFSGSGSGTDFTLKISRVEAEDLGVYFCSQSTHVPPLTFGAGTKLELKRGGGGSGGGGSGGGGSEVQLLQSGPELEKPGASVMISCKASGSSFTGYNMNWVRQNIGKSLEWIGAIDPYYGGTSYNQKFKGRATLTVDKSSSTAYMHLKSLTSEDSAVYYCVSGMEYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 230 - DNA, 2305 bp, Artificial Sequence
  (GD2-28-41BBL CAR nucleotide sequence)
gcgatcgcaccatggccttaccagtgaccgccttgctcctgccgctggccttgctgctccacgccgccaggccggagatcgtgatgacccagagccccgccaccctgagcgtgagccccggcgagagggccaccctgagctgcaggagcagccagagcctggtgcacaggaacggcaacacctacctgcactggtacctgcagaagcccggccagagccccaagctgctgatccacaaggtgagcaacaggttcagcggcgtgcccgacaggttcagcggcagcggcagcggcaccgacttcaccctgaagatcagcagggtggaggccgaggacctgggcgtgtacttctgcagccagagcacccacgtgccccccctgaccttcggcgccggcaccaagctggagctgaagaggggcggcggcggcagcggcggcggcggcagcggcggcggcggcagcgaggtgcagctgctgcagagcggccccgagctggagaagcccggcgccagcgtgatgatcagctgcaaggccagcggcagcagcttcaccggctacaacatgaactgggtgaggcagaacatcggcaagagcctggagtggatcggcgccatcgacccctactacggcggcaccagctacaaccagaagttcaagggcagggccaccctgaccgtggacaagagcagcagcaccgcctacatgcacctgaagagcctgaccagcgaggacagcgccgtgtactactgcgtgagcggcatggagtactggggccagggcaccagcgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataagtttaaac

SEQ ID NO: 231 - protein, 819 aa, Artificial Sequence
  (GD2-28-IL-15/IL-15sushi anchor CAR amino acid sequence)
MALPVTALLLPLALLLHAARPEIVMTQSPATLSVSPGERATLSCRSSQSLVHRNGNTYLHWYLQKPGQSPKLLIHKVSNRFSGVPDRFSGSGSGTDFTLKISRVEAEDLGVYFCSQSTHVPPLTFGAGTKLELKRGGGGSGGGGSGGGGSEVQLLQSGPELEKPGASVMISCKASGSSFTGYNMNWVRQNIGKSLEWIGAIDPYYGGTSYNQKFKGRATLTVDKSSSTAYMHLKSLTSEDSAVYYCVSGMEYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRTTTPAPRPPTPAPTIASQPLSLRPEACRPAAGGAVHTRGLDFACDVAISTSTVLLCGLSAVSLLACY

SEQ ID NO: 232 - DNA, 2479 bp, Artificial Sequence
  (GD2-28-IL-15/IL-15sushi anchor CAR nucleotide sequence)
gcgatcgcaccatggccttaccagtgaccgccttgctcctgccgctggccttgctgctccacgccgccaggccggagatcgtgatgacccagagccccgccaccctgagcgtgagccccggcgagagggccaccctgagctgcaggagcagccagagcctggtgcacaggaacggcaacacctacctgcactggtacctgcagaagcccggccagagccccaagctgctgatccacaaggtgagcaacaggttcagcggcgtgcccgacaggttcagcggcagcggcagcggcaccgacttcaccctgaagatcagcagggtggaggccgaggacctgggcgtgtacttctgcagccagagcacccacgtgccccccctgaccttcggcgccggcaccaagctggagctgaagaggggcggcggcggcagcggcggcggcggcagcggcggcggcggcagcgaggtgcagctgctgcagagcggccccgagctggagaagcccggcgccagcgtgatgatcagctgcaaggccagcggcagcagcttcaccggctacaacatgaactgggtgaggcagaacatcggcaagagcctggagtggatcggcgccatcgacccctactacggcggcaccagctacaaccagaagttcaagggcagggccaccctgaccgtggacaagagcagcagcaccgcctacatgcacctgaagagcctgaccagcgaggacagcgccgtgtactactgcgtgagcggcatggagtactggggccagggcaccagcgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcagatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagaaccaccacccccgcccccaggccccccacccccgcccccaccatcgccagccagcccctgagcctgaggcccgaggcctgcaggcccgccgccggcggcgccgtgcacaccaggggcctggacttcgcctgcgacgtggctatctccacgtccactgtcctgctgtgtgggctgagcgctgtgtctctcctggcatgctactaagtttaaac

SEQ ID NO: 233 - protein, 780 aa, Artificial Sequence
  (GD2-28-IL-15/IL-15sushi CAR amino acid sequence)
MALPVTALLLPLALLLHAARPEIVMTQSPATLSVSPGERATLSCRSSQSLVHRNGNTYLHWYLQKPGQSPKLLIHKVSNRFSGVPDRFSGSGSGTDFTLKISRVEAEDLGVYFCSQSTHVPPLTFGAGTKLELKRGGGGSGGGGSGGGGSEVQLLQSGPELEKPGASVMISCKASGSSFTGYNMNWVRQNIGKSLEWIGAIDPYYGGTSYNQKFKGRATLTVDKSSSTAYMHLKSLTSEDSAVYYCVSGMEYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 234 - DNA, 2362 bp, Artificial Sequence
  (GD2-28-IL-15/IL-15sushi CAR nucleotide sequence)
gcgatcgcaccatggccttaccagtgaccgccttgctcctgccgctggccttgctgctccacgccgccaggccggagatcgtgatgacccagagccccgccaccctgagcgtgagccccggcgagagggccaccctgagctgcaggagcagccagagcctggtgcacaggaacggcaacacctacctgcactggtacctgcagaagcccggccagagccccaagctgctgatccacaaggtgagcaacaggttcagcggcgtgcccgacaggttcagcggcagcggcagcggcaccgacttcaccctgaagatcagcagggtggaggccgaggacctgggcgtgtacttctgcagccagagcacccacgtgccccccctgaccttcggcgccggcaccaagctggagctgaagaggggcggcggcggcagcggcggcggcggcagcggcggcggcggcagcgaggtgcagctgctgcagagcggccccgagctggagaagcccggcgccagcgtgatgatcagctgcaaggccagcggcagcagcttcaccggctacaacatgaactgggtgaggcagaacatcggcaagagcctggagtggatcggcgccatcgacccctactacggcggcaccagctacaaccagaagttcaagggcagggccaccctgaccgtggacaagagcagcagcaccgcctacatgcacctgaagagcctgaccagcgaggacagcgccgtgtactactgcgtgagcggcatggagtactggggccagggcaccagcgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 235 - protein, 993 aa, Artificial Sequence
  (GD2-BB-GD3-28-2G cCAR amino acid sequence)
MALPVTALLLPLALLLHAARPEIVMTQSPATLSVSPGERATLSCRSSQSLVHRNGNTYLHWYLQKPGQSPKLLIHKVSNRFSGVPDRFSGSGSGTDFTLKISRVEAEDLGVYFCSQSTHVPPLTFGAGTKLELKRGGGGSGGGGSGGGGSEVQLLQSGPELEKPGASVMISCKASGSSFTGYNMNWVRQNIGKSLEWIGAIDPYYGGTSYNQKFKGRATLTVDKSSSTAYMHLKSLTSEDSAVYYCVSGMEYWGQGTSVTVSSTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMALPVTALLLPLALLLHAARPEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSGGGGSGGGGSGGGGSDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 236 - DNA, 3001 bp, Artificial Sequence
  (GD2-BB-GD3-28-2G cCAR nucleotide sequence)
gcgatcgcaccatggccttaccagtgaccgccttgctcctgccgctggccttgctgctccacgccgccaggccggagatcgtgatgacccagagccccgccaccctgagcgtgagccccggcgagagggccaccctgagctgcaggagcagccagagcctggtgcacaggaacggcaacacctacctgcactggtacctgcagaagcccggccagagccccaagctgctgatccacaaggtgagcaacaggttcagcggcgtgcccgacaggttcagcggcagcggcagcggcaccgacttcaccctgaagatcagcagggtggaggccgaggacctgggcgtgtacttctgcagccagagcacccacgtgccccccctgaccttcggcgccggcaccaagctggagctgaagaggggcggcggcggcagcggcggcggcggcagcggcggcggcggcagcgaggtgcagctgctgcagagcggccccgagctggagaagcccggcgccagcgtgatgatcagctgcaaggccagcggcagcagcttcaccggctacaacatgaactgggtgaggcagaacatcggcaagagcctggagtggatcggcgccatcgacccctactacggcggcaccagctacaaccagaagttcaagggcagggccaccctgaccgtggacaagagcagcagcaccgcctacatgcacctgaagagcctgaccagcgaggacagcgccgtgtactactgcgtgagcggcatggagtactggggccagggcaccagcgtgaccgtgagcagcaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatggccttaccagtgaccgccttgctcctgccgctggccttgctgctccacgccgccaggccggaggtgaccctggtggagagcggcggcgacttcgtgaagcccggcggcagcctgaaggtgagctgcgccgccagcggcttcgccttcagccactacgccatgagctgggtgaggcagacccccgccaagaggctggagtgggtggcctacatcagcagcggcggcagcggcacctactacagcgacagcgtgaagggcaggttcaccatcagcagggacaacgccaagaacaccctgtacctgcagatgaggagcctgaggagcgaggacagcgccatgtacttctgcaccagggtgaagctgggcacctactacttcgacagctggggccagggcaccaccctgaccgtgagcagcggaggggggggatccgggggaggaggctccggcggaggcggaagcgacatccagatgacccagaccgccagcagcctgcccgccagcctgggcgacagggtgaccatcagctgcagcgccagccaggacatcagcaactacctgaactggtaccagcagaagcccgacggcaccgtgaagctgctgatcttctacagcagcaacctgcacagcggcgtgcccagcaggttcagcggcggcggcagcggcaccgactacagcctgaccatcagcaacctggagcccgaggacatcgccacctacttctgccaccagtacagcaagctgccctggaccttcggcggcggcaccaagctggagatcaagaggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 237 - protein, 487 aa, Artificial Sequence
  (GD2-BBpre-2G CAR amino acid sequence)
MALPVTALLLPLALLLHAARPEIVMTQSPATLSVSPGERATLSCRSSQSLVHRNGNTYLHWYLQKPGQSPKLLIHKVSNRFSGVPDRFSGSGSGTDFTLKISRVEAEDLGVYFCSQSTHVPPLTFGAGTKLELKRGGGGSGGGGSGGGGSEVQLLQSGPELEKPGASVMISCKASGSSFTGYNMNWVRQNIGKSLEWIGAIDPYYGGTSYNQKFKGRATLTVDKSSSTAYMHLKSLTSEDSAVYYCVSGMEYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 238 - DNA, 1483 bp, Artificial Sequence
  (GD2-BBpre-2G CAR nucleotide sequence)
gcgatcgcaccatggccctgcccgtgaccgccctgctgctgcccctggccctgctgctgcacgccgccaggcccgagatcgtgatgacccagagccccgccaccctgagcgtgagccccggcgagagggccaccctgagctgcaggagcagccagagcctggtgcacaggaacggcaacacctacctgcactggtacctgcagaagcccggccagagccccaagctgctgatccacaaggtgagcaacaggttcagcggcgtgcccgacaggttcagcggcagcggcagcggcaccgacttcaccctgaagatcagcagggtggaggccgaggacctgggcgtgtacttctgcagccagagcacccacgtgccccccctgaccttcggcgccggcaccaagctggagctgaagaggggcggcggcggcagcggcggcggcggcagcggcggcggcggcagcgaggtgcagctgctgcagagcggccccgagctggagaagcccggcgccagcgtgatgatcagctgcaaggccagcggcagcagcttcaccggctacaacatgaactgggtgaggcagaacatcggcaagagcctggagtggatcggcgccatcgacccctactacggcggcaccagctacaaccagaagttcaagggcagggccaccctgaccgtggacaagagcagcagcaccgcctacatgcacctgaagagcctgaccagcgaggacagcgccgtgtactactgcgtgagcggcatggagtactggggccagggcaccagcgtgaccgtgagcagcaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaaacggggcagaaagaaactcctgtatatattcaaacaaccatttatgagaccagtacaaactactcaagaggaagatggctgtagctgccgatttccagaagaagaagaaggaggatgtgaactgagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

SEQ ID NO: 239 - protein, 477 aa, Artificial Sequence
  (GD3-28-2G CAR amino acid sequence)
MALPVTALLLPLALLLHAARPEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSGGGGSGGGGSGGGGSDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDA

SEQ ID NO: 240 - DNA, 1480 bp, Artificial Sequence
  (GD3-28-2G CAR nucleotide sequence)
gcgatcgcaccatggccttaccagtgaccgccttgctcctgccgctggccttgctgctccacgccgccaggccggaggtgaccctggtggagagcggcggcgacttcgtgaagcccggcggcagcctgaaggtgagctgcgccgccagcggcttcgccttcagccactacgccatgagctgggtgaggcagacccccgccaagaggctggagtgggtggcctacatcagcagcggcggcagcggcacctactacagcgacagcgtgaagggcaggttcaccatcagcagggacaacgccaagaacaccctgtacctgcagatgaggagcctgaggagcgaggacagcgccatgtacttctgcaccagggtgaagctgggcacctactacttcgacagctggggccagggcaccaccctgaccgtgagcagcggaggggggggatccgggggaggaggctccggcggaggcggaagcgacatccagatgacccagaccgccagcagcctgcccgccagcctgggcgacagggtgaccatcagctgcagcgccagccaggacatcagcaactacctgaactggtaccagcagaagcccgacggcaccgtgaagctgctgatcttctacagcagcaacctgcacagcggcgtgcccagcaggttcagcggcggcggcagcggcaccgactacagcctgaccatcagcaacctggagcccgaggacatcgccacctacttctgccaccagtacagcaagctgccctggaccttcggcggcggcaccaagctggagatcaagaggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgctaagtttaaac

SEQ ID NO: 241 - protein, 1057 aa, Artificial Sequence
  (GD3-28-2G-4-1BBL-IL15/IL-15sushi CAR amino acid sequence)
MALPVTALLLPLALLLHAARPEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSGGGGSGGGGSGGGGSDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSEGSGATNFLSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 242 - DNA, 3193 bp, Artificial Sequence
  (GD3-28-2G-4-1BBL-IL15/IL-15sushi nucleotide sequence)
gcgatcgcaccatggccttaccagtgaccgccttgctcctgccgctggccttgctgctccacgccgccaggccggaggtgaccctggtggagagcggcggcgacttcgtgaagcccggcggcagcctgaaggtgagctgcgccgccagcggcttcgccttcagccactacgccatgagctgggtgaggcagacccccgccaagaggctggagtgggtggcctacatcagcagcggcggcagcggcacctactacagcgacagcgtgaagggcaggttcaccatcagcagggacaacgccaagaacaccctgtacctgcagatgaggagcctgaggagcgaggacagcgccatgtacttctgcaccagggtgaagctgggcacctactacttcgacagctggggccagggcaccaccctgaccgtgagcagcggaggggggggatccgggggaggaggctccggcggaggcggaagcgacatccagatgacccagaccgccagcagcctgcccgccagcctgggcgacagggtgaccatcagctgcagcgccagccaggacatcagcaactacctgaactggtaccagcagaagcccgacggcaccgtgaagctgctgatcttctacagcagcaacctgcacagcggcgtgcccagcaggttcagcggcggcggcagcggcaccgactacagcctgaccatcagcaacctggagcccgaggacatcgccacctacttctgccaccagtacagcaagctgccctggaccttcggcggcggcaccaagctggagatcaagaggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaaggaagcggagctactaacttcttgagcctgctgaagcaggctggagacgtggaggagaaccctggacctatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 243 - protein, 661 aa, Artificial Sequence
  (GD3-28-2G-IL15xp CAR amino acid sequence)
MALPVTALLLPLALLLHAARPEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSGGGGSGGGGSGGGGSDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 244 - DNA, 2005 bp, Artificial Sequence
  (GD3-28-2G-IL15xp nucleotide sequence)
gcgatcgcaccatggccttaccagtgaccgccttgctcctgccgctggccttgctgctccacgccgccaggccggaggtgaccctggtggagagcggcggcgacttcgtgaagcccggcggcagcctgaaggtgagctgcgccgccagcggcttcgccttcagccactacgccatgagctgggtgaggcagacccccgccaagaggctggagtgggtggcctacatcagcagcggcggcagcggcacctactacagcgacagcgtgaagggcaggttcaccatcagcagggacaacgccaagaacaccctgtacctgcagatgaggagcctgaggagcgaggacagcgccatgtacttctgcaccagggtgaagctgggcacctactacttcgacagctggggccagggcaccaccctgaccgtgagcagcggaggggggggatccgggggaggaggctccggcggaggcggaagcgacatccagatgacccagaccgccagcagcctgcccgccagcctgggcgacagggtgaccatcagctgcagcgccagccaggacatcagcaactacctgaactggtaccagcagaagcccgacggcaccgtgaagctgctgatcttctacagcagcaacctgcacagcggcgtgcccagcaggttcagcggcggcggcagcggcaccgactacagcctgaccatcagcaacctggagcccgaggacatcgccacctacttctgccaccagtacagcaagctgccctggaccttcggcggcggcaccaagctggagatcaagaggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctaagtttaaac

SEQ ID NO: 245 - protein, 761 aa, Artificial Sequence
  (GD3-28-41BBL CAR amino acid sequence)
MALPVTALLLPLALLLHAARPEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSGGGGSGGGGSGGGGSDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMEYASDASLDPEAPWPPAPRARACRVLPWALVAGLLLLLLLAAACAVFLACPWAVSGARASPGSAASPRLREGPELSPDDPAGLLDLRQGMFAQLVAQNVLLIDGPLSWYSDPGLAGVSLTGGLSYKEDTKELVVAKAGVYYVFFQLELRRVVAGEGSGSVSLALHLQPLRSAAGAAALALTVDLPPASSEARNSAFGFQGRLLHLSAGQRLGVHLHTEARARHAWQLTQGATVLGLFRVTPEIPAGLPSPRSE

SEQ ID NO: 246 - DNA, 2305 bp, Artificial Sequence
  (GD3-28-41BBL nucleotide sequence)
gcgatcgcaccatggccttaccagtgaccgccttgctcctgccgctggccttgctgctccacgccgccaggccggaggtgaccctggtggagagcggcggcgacttcgtgaagcccggcggcagcctgaaggtgagctgcgccgccagcggcttcgccttcagccactacgccatgagctgggtgaggcagacccccgccaagaggctggagtgggtggcctacatcagcagcggcggcagcggcacctactacagcgacagcgtgaagggcaggttcaccatcagcagggacaacgccaagaacaccctgtacctgcagatgaggagcctgaggagcgaggacagcgccatgtacttctgcaccagggtgaagctgggcacctactacttcgacagctggggccagggcaccaccctgaccgtgagcagcggaggggggggatccgggggaggaggctccggcggaggcggaagcgacatccagatgacccagaccgccagcagcctgcccgccagcctgggcgacagggtgaccatcagctgcagcgccagccaggacatcagcaactacctgaactggtaccagcagaagcccgacggcaccgtgaagctgctgatcttctacagcagcaacctgcacagcggcgtgcccagcaggttcagcggcggcggcagcggcaccgactacagcctgaccatcagcaacctggagcccgaggacatcgccacctacttctgccaccagtacagcaagctgccctggaccttcggcggcggcaccaagctggagatcaagaggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatggaatacgcctctgacgcttcactggaccccgaagccccgtggcctcccgcgccccgcgctcgcgcctgccgcgtactgccttgggccctggtcgcggggctgctgctgctgctgctgctcgctgccgcctgcgccgtcttcctcgcctgcccctgggccgtgtccggggctcgcgcctcgcccggctccgcggccagcccgagactccgcgagggtcccgagctttcgcccgacgatcccgccggcctcttggacctgcggcagggcatgtttgcgcagctggtggcccaaaatgttctgctgatcgatgggcccctgagctggtacagtgacccaggcctggcaggcgtgtccctgacggggggcctgagctacaaagaggacacgaaggagctggtggtggccaaggctggagtctactatgtcttctttcaactagagctgcggcgcgtggtggccggcgagggctcaggctccgtttcacttgcgctgcacctgcagccactgcgctctgctgctggggccgccgccctggctttgaccgtggacctgccacccgcctcctccgaggctcggaactcggccttcggtttccagggccgcttgctgcacctgagtgccggccagcgcctgggcgtccatcttcacactgaggccagggcacgccatgcctggcagcttacccagggcgccacagtcttgggactcttccgggtgacccccgaaatcccagccggactcccttcaccgaggtcggaataagtttaaac

SEQ ID NO: 247 - protein, 819 aa, Artificial Sequence
  (GD3-28-IL15/IL-15sushi anchor CAR amino acid sequence)
MALPVTALLLPLALLLHAARPEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSGGGGSGGGGSGGGGSDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRTTTPAPRPPTPAPTIASQPLSLRPEACRPAAGGAVHTRGLDFACDVAISTSTVLLCGLSAVSLLACY

SEQ ID NO: 248 - DNA, 2479 bp, Artificial Sequence
  (GD3-28-IL15/IL-15sushi anchor nucleotide sequence)
gcgatcgcaccatggccttaccagtgaccgccttgctcctgccgctggccttgctgctccacgccgccaggccggaggtgaccctggtggagagcggcggcgacttcgtgaagcccggcggcagcctgaaggtgagctgcgccgccagcggcttcgccttcagccactacgccatgagctgggtgaggcagacccccgccaagaggctggagtgggtggcctacatcagcagcggcggcagcggcacctactacagcgacagcgtgaagggcaggttcaccatcagcagggacaacgccaagaacaccctgtacctgcagatgaggagcctgaggagcgaggacagcgccatgtacttctgcaccagggtgaagctgggcacctactacttcgacagctggggccagggcaccaccctgaccgtgagcagcggaggggggggatccgggggaggaggctccggcggaggcggaagcgacatccagatgacccagaccgccagcagcctgcccgccagcctgggcgacagggtgaccatcagctgcagcgccagccaggacatcagcaactacctgaactggtaccagcagaagcccgacggcaccgtgaagctgctgatcttctacagcagcaacctgcacagcggcgtgcccagcaggttcagcggcggcggcagcggcaccgactacagcctgaccatcagcaacctggagcccgaggacatcgccacctacttctgccaccagtacagcaagctgccctggaccttcggcggcggcaccaagctggagatcaagaggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcagatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagaaccaccacccccgcccccaggccccccacccccgcccccaccatcgccagccagcccctgagcctgaggcccgaggcctgcaggcccgccgccggcggcgccgtgcacaccaggggcctggacttcgcctgcgacgtggctatctccacgtccactgtcctgctgtgtgggctgagcgctgtgtctctcctggcatgctactaagtttaaac

SEQ ID NO: 249 - protein, 780 aa, Artificial Sequence
  (GD3-28-IL15/IL-15sushi CAR amino acid sequence)
MALPVTALLLPLALLLHAARPEVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSGGGGSGGGGSGGGGSDIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRTTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGEGRGSLLTCGDVEENPGPMYRMQLLSCIALSLALVTNSGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQAPRRARGCRTLGLPALLLLLLLRPPATRGITCPPPMSVEHADIWVKSYSLYSRERYICNSGFKRKAGTSSLTECVLNKATNVAHWTTPSLKCIR

SEQ ID NO: 250 - DNA, 2362 bp, Artificial Sequence
  (GD3-28-IL15/IL-15sushi CAR nucleotide sequence)
gcgatcgcaccatggccttaccagtgaccgccttgctcctgccgctggccttgctgctccacgccgccaggccggaggtgaccctggtggagagcggcggcgacttcgtgaagcccggcggcagcctgaaggtgagctgcgccgccagcggcttcgccttcagccactacgccatgagctgggtgaggcagacccccgccaagaggctggagtgggtggcctacatcagcagcggcggcagcggcacctactacagcgacagcgtgaagggcaggttcaccatcagcagggacaacgccaagaacaccctgtacctgcagatgaggagcctgaggagcgaggacagcgccatgtacttctgcaccagggtgaagctgggcacctactacttcgacagctggggccagggcaccaccctgaccgtgagcagcggaggggggggatccgggggaggaggctccggcggaggcggaagcgacatccagatgacccagaccgccagcagcctgcccgccagcctgggcgacagggtgaccatcagctgcagcgccagccaggacatcagcaactacctgaactggtaccagcagaagcccgacggcaccgtgaagctgctgatcttctacagcagcaacctgcacagcggcgtgcccagcaggttcagcggcggcggcagcggcaccgactacagcctgaccatcagcaacctggagcccgaggacatcgccacctacttctgccaccagtacagcaagctgccctggaccttcggcggcggcaccaagctggagatcaagaggaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggcagcggcgaaggccgcggcagcctgctgacctgcggcgatgtggaagaaaacccgggccccatgtacagaatgcagctgctgagctgcatcgccctgagcctggccctggtgaccaacagcggcatccacgtgttcatcctgggctgcttcagcgccggcctgcccaagaccgaggccaactgggtgaacgtgatcagcgacctgaagaagatcgaggacctgatccagagcatgcacatcgacgccaccctgtacaccgagagcgacgtgcaccccagctgcaaggtgaccgccatgaagtgcttcctgctggagctgcaggtgatcagcctggagagcggcgacgccagcatccacgacaccgtggagaacctgatcatcctggccaacaacagcctgagcagcaacggcaacgtgaccgagagcggctgcaaggagtgcgaggagctggaggagaagaacatcaaggagttcctgcagagcttcgtgcacatcgtgcagatgttcatcaacaccagctccggcggcggctccggcggcggcggctccggcggcggcggctccggcggcggcggctccggcggcggctccctgcaggcccccagaagagccagaggctgcagaaccctgggcctgcccgccctgctgctgctgctgctgctgagaccccccgccaccagaggcatcacctgccccccccccatgagcgtggagcacgccgacatctgggtgaagagctacagcctgtacagcagagagagatacatctgcaacagcggcttcaagagaaaggccggcaccagcagcctgaccgagtgcgtgctgaacaaggccaccaacgtggcccactggaccacccccagcctgaagtgcatcagataagtttaaac

SEQ ID NO: 251 - protein, 1004 aa, Artificial Sequence
  (BCMA-A7D-CD19b-BBpre-2G CAR amino acid sequence)
MALPVTALLLPLALLLHAARPDVVMTQSHRFMSTSVGDRVSITCRASQDVNTAVSWYQQKPGQSPKLLIFSASYRYTGVPDRFTGSGSGADFTLTISSVQAEDLAVYYCQQHYSTPWTFGGGTKLDIKGGGGSGGGGSGGGGSQIQLVQSGPDLKKPGETVKLSCKASGYTFTNFGMNWVKQAPGKGFKWMAWINTYTGESYFADDFKGRFAFSVETSATTAYLQINNLKTEDTATYFCARGEIYYGYDGGFAYWGQGTLVTVSATTTPAPRPPTPAPTIASQPLSLRPEACRPAAGGAVHTRGLDFACDIYIWAPLAGTCGVLLLSLVITLYCRSKRSRLLHSDYMNMTPRRPGPTRKHYQPYAPPRDFAAYRSRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRGSGATNFSLLKQAGDVEENPGPMALPVTALLLPLALLLHAARPEVQLQQSGPELIKPGASVKMSCKASGYTFTSYVMHWVKQKPGQGLEWIGYINPYNDGTKYNEKFKGKATLTSDKSSSTAYMELSSLTSEDSAVYYCARGTYYYGSRVFDYWGQGTTLTVSSGGGGSGGGGSGGGGSDIVMTQAAPSIPVTPGESVSISCRSSKSLLNSNGNTYLYWFLQRPGQSPQLLIYRMSNLASGVPDRFSGSGSGTAFTLRISRVEAEDVGVYYCMQHLEYPFTFGAGTKLELKRTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 252 - DNA, 3023 bp, Artificial Sequence
  (BCMA-A7D-CD19b-BBpre-2G CAR amino acid sequence)
atggccttaccagtgaccgccttgctcctgccgctggccttgctgctccacgccgccaggccggacgtggtgatgacccagagccacaggttcatgagcaccagcgtgggcgacagggtgagcatcacctgcagggccagccaggacgtgaacaccgccgtgagctggtaccagcagaagcccggccagagccccaagctgctgatcttcagcgccagctacaggtacaccggcgtgcccgacaggttcaccggcagcggcagcggcgccgacttcaccctgaccatcagcagcgtgcaggccgaggacctggccgtgtactactgccagcagcactacagcaccccctggaccttcggcggcggcaccaagctggacatcaagggaggggggggatccgggggaggaggctccggcggaggcggaagccagatccagctggtgcagagcggccccgacctgaagaagcccggcgagaccgtgaagctgagctgcaaggccagcggctacaccttcaccaacttcggcatgaactgggtgaagcaggcccccggcaagggcttcaagtggatggcctggatcaacacctacaccggcgagagctacttcgccgacgacttcaagggcaggttcgccttcagcgtggagaccagcgccaccaccgcctacctgcagatcaacaacctgaagaccgaggacaccgccacctacttctgcgccaggggcgagatctactacggctacgacggcggcttcgcctactggggccagggcaccctggtgaccgtgagcgccaccacgacgccagcgccgcgaccaccaacaccggcgcccaccatcgcgtcgcagcccctgtccctgcgcccagaggcgtgccggccagcggcggggggcgcagtgcacacgagggggctggacttcgcctgtgatatctacatctgggcgcccttggccgggacttgtggggtccttctcctgtcactggttatcaccctttactgcaggagtaagaggagcaggctcctgcacagtgactacatgaacatgactccccgccgccccgggcccacccgcaagcattaccagccctatgccccaccacgcgacttcgcagcctatcgctccagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcggaagcggagccaccaacttcagcctgctgaagcaggccggcgacgtggaggagaaccccggccccatggccctgcccgtgaccgccctgctgctgcccctggccctgctgctgcacgccgccaggcccgaggtccagctgcagcagtctggacctgagctgataaagcctggggcttcagtgaagatgtcctgcaaggcttctggatacacattcactagctatgttatgcactgggtgaagcagaagcctgggcagggccttgagtggattggatatattaatccttacaatgatggtactaagtacaatgagaagttcaaaggcaaggccacactgacttcagacaaatcctccagcacagcctacatggagctcagcagcctgacctctgaggactctgcggtctattactgtgcaagagggacttattactacggtagtagggtatttgactactggggccaaggcaccactctcacagtctcctcaggtggagggggctcaggcggaggtggctctgggggtggaggctcggacattgtgatgactcaggctgcaccctctatacctgtcactcctggagagtcagtatccatctcctgcaggtctagtaagagtctcctgaatagtaatggcaacacttacttgtattggttcctgcagaggccaggccagtctcctcagctcctgatatatcggatgtccaaccttgcctcaggagtcccagacaggttcagtggcagtgggtcaggaactgctttcacactgagaatcagtagagtggaggctgaggatgtgggtgtttattactgtatgcaacatctagaatatccgttcacgttcggtgctgggaccaagctggagctgaaacggaccaccacccccgcccccaggccccccacccccgcccccaccatcgccagccagcccctgagcctgaggcccgaggcctgcaggcccgccgccggcggcgccgtgcacaccaggggcctggacttcgcctgcgacatctacatctgggcccccctggccggcacctgcggcgtgctgctgctgagcctggtgatcaccctgtactgcaaacggggcagaaagaaactcctgtatatattcaaacaaccatttatgagaccagtacaaactactcaagaggaagatggctgtagctgccgatttccagaagaagaagaaggaggatgtgaactgagggtgaagttcagcaggagcgccgacgcccccgcctaccagcagggccagaaccagctgtacaacgagctgaacctgggcaggagggaggagtacgacgtgctggacaagaggaggggcagggaccccgagatgggcggcaagccccagaggaggaagaacccccaggagggcctgtacaacgagctgcagaaggacaagatggccgaggcctacagcgagatcggcatgaagggcgagaggaggaggggcaagggccacgacggcctgtaccagggcctgagcaccgccaccaaggacacctacgacgccctgcacatgcaggccctgccccccaggtaagtttaaac

The invention claimed is:

1. A method for treating an autoimmune disease, said method comprising administering to a patient in need thereof an ex vivo engineered T cell or NK cell co-expressing two distinct chimeric antigen receptor (CAR) units at the cell surface, wherein the engineered T cell or NK cell comprises a nucleotide sequence comprising from 5' to 3' a nucleotide encoding a promoter selected from human elongation factor-1 alpha (EF-1α) or spleen focus forming virus (SFFV), a first polynucleotide encoding a first chimeric antigen receptor polypeptide (CAR), a nucleotide encoding a first cleavage peptide, and a second polynucleotide encoding a second chimeric antigen receptor polypeptide (CAR), wherein the engineered cell further comprises a nucleotide encoding secreted IL-15/IL-15sushi or a functional fragment thereof, wherein the nucleotide encoding said enhancer is attached to the nucleotide encoding the first CAR or the nucleotide encoding the second CAR by a nucleotide encoding a second cleavage peptide that flanks either end of the two distinct encoded CAR units, wherein:

the first CAR comprises a first signal peptide, a first antibody binding domain, a first hinge region, a first transmembrane domain, a first co-stimulatory domain, and a first signaling domain; and the second CAR comprises a second signal peptide, a second antibody binding domain, a second hinge region, a second transmembrane domain, a second co-stimulatory domain, and a second signaling domain; and wherein the first antibody binding domain and the second antibody binding domain are different and each bind to a different target, wherein the targets of the first and second antibody binding domains irrespective of order are CD19 and BMCA (CD269), wherein the first and second co-stimulatory domains are intracellular, and wherein the first and second cleavage peptides are selected from the group consisting of porcine teschovirus-1 2A (P2A), thoseaasigna virus 2A (T2A), equine rhinitis A virus (ERAV) 2A (E2A), and FMDV 2A (F2A), and wherein said autoimmune disease is systemic lupus erythematosus (SLE).

2. The method according to claim 1, wherein the co-stimulatory domain is CD28.

* * * * *